United States Patent 7,090,973 (NUCLEIC ACID SEQUENCES RELATING TO BACTEROIDES FRAGILIS FOR DIAGNOSTICS AND THERAPEUTICS) - sequence listing, part 4

SEQ ID NO: 10236 - protein, 463 aa, B.fragilis
RKRLFYCILVMNDKYEERLGTDRMLPLVFRMALPAVIAQIVNLLYNIVDRIYIGHIPGIGTQALAGIGVAGSLIILISAFSAIVAGGGAPLAAIALGQGNRTHAEKILGNGFVLLLFFTLLTSGLSYLFMEPILLFTGASEQTLGYATAYLSIYLIGTLFVEVSVGLNTFINTQGRPGIAMLSIVIGALLNILLDPLFIFVFDWGVKGAALATIISQACSAGWVLFFLTSRRASLRLEPRYMRLDRKVVGAILALGASPFIMASTESLVGFVLNGSLKTFGDIYVSALTIMQSAMLFVSVPLAGFALGFVPIVSYNYGHGNRERVKECFKIVMTFMFLFNLVLILLMILFPSVIASAFTSDEKLIETVVQVMPVFLAGMTIFGLQRACQNMFVALGQAKVSIFIALLRKVILLIPLALMLPYLMGVMGVYAAEAISDAAAAICCTVIFAVQFPRIMNKLTVRS

SEQ ID NO: 10237 - protein, 583 aa, B.fragilis
NMIMMKRLICMYAFLLCLVCVLPAQEREVKLKIVQTSDVHGNYFPYNFITQKEWGGSLARVYALVQKNREVYKGNLILLDNGDILQGQPSAYYYNYIDTVAPHVCAEMMNFMGYDAGNMGNHDVETGRAVFDRWIGECNFPVLGANIVETATGETHLPPYRVLERDGVKIVVLGMITPAIPAWLSENLWQGLRFDDMEETARKWMKVIREKENPDLVIGLFHAGQDAFVMSGRYNENASLNVAKNVPGFDMVLMGHDHARECKKVVNVAGDSVLVIDPASNGIVVSDIDVTLKLKDGKVVSKQIDGVLTDTKEYGVSESFMRHFALQYGAVEKFVSKKIGVFTEDLSTRPAYFGSSAFIDFIHSLQLDISGADISFAAPLSFDAEIKKGDIRVSDMFNLYKYENMLYVMKLSGKEIKDFLEESYYMWTNRMKSPEDHLLWLKEKRRAGAEDRASFQNFSFNFDSAAGIIYTVDVTRPKGEKVTIVSMADGSPFRMDHIYKVALNSYRGNGGGELLTKGSGIPQEKLKERIIFSTDKDLRFYLMQYIEKKGTLDPRALNQWKFVPEEWVKPAAQRDYEYLFGGK

SEQ ID NO: 10238 - protein, 112 aa, B.fragilis
  UNSURE (5): Identity of amino acid sequences at the above locations are unknown.
VGHIXKILLSFLLLTLFVTYQVSITMFTHVHYVNGVMIAHSHPYKGTHSHTASNIIVIAHFAAFHSLEVDVHYDFTPERPILFTVEIPESIPVTAGTHLQVISLRAPPAELA

SEQ ID NO: 10239 - protein, 766 aa, B.fragilis
QKRMKHYIVMLVLACVSMSSYAVNPIKEGNMIAGHVIVKGTEEGIPFATVMILGTNRGAVSNEEGQFEFRKLAAGKYTLRVQVMGYKTQEKTITVSAEATSVVHFQMEEVSFTTDEVVVSANRNEVSRKAAPVVVNVMSAKLFETVNSTDLAKSLNFQSGLRVENNCQNCGFPQVRINGLEGPYSQILINSRPIISALSGVYGLEQIPVNMIERVEVVRGGGSALFGANAVGGTINIITKDPINNSFQVASTMSNMNGKSWEQYMGGNVSLVAKDNSYGIALYETYRNRNPYDADGDGFSELGKLNMNTFGMRAYYRPNYFSRINVEYHTTNEFRRGGNKFNLQPHEADITEQTKHIINSGGVSYDRYWGEKHKMSVYGSIQHTDRNSYYGAQKDMNAYGKTNDLTWVVGGMYVGNMDRCLFAPATFTGGVEYQSNSLHDVMTGYHRDMQQDVRIAGGFVQNEWRLNRWTMLVGARLDKHNLIDHPIFSPRVNFLYKPSDNLQARLTYSTGFRAPQAYDEDLHVTAVGGEGVQIRLADGLREERSNSFSGSVDWSFPMGHWQSNILLEGFYTDLHHVFVLEDIGEDQNGDKIKERRNGSGAKVYGVNLDAKVAHGREAQLQLGFTVQRSRYNRAEVWTSEGEEEQTTKRMPRTPDYYGYFTFTSAPLKNFDFSLSGTYTGKMIVPHMAGYIEKSRMEHTPQFMDLNLKLNYTFVLKDHIKMQVNGGVQNIFNSFQKDLDKGEFRDAGYFYGPTQPRTYFVGIKIMN

SEQ ID NO: 10240 - protein, 224 aa, B.fragilis
NESFYFEKLIYINRFSYFCPAIYNNLSIYNIMENLKETVDIVVNSRYPEMNREGRELLAQVLIRKELEKGEMLLNEGQISRHMVFVGKGMLRQFYYKNGKDVTEHFSYEGCILMCIESLLKQEPTHLMAEALEPAVVYMLPYDVLQKLLEQSKEINAFYRKVLEYSLIVSQIKADSWRFETARERYNLLLHHHPEIIKRAPLSHIASYLLMTPETLSRVRSGVL

SEQ ID NO: 10241 - protein, 653 aa, B.fragilis
RREPLDQVTPESYFQNADHLAAYSISKYQNLFSTHSGFSAGTVNNDGATDNMVSGGSSGSGLQNYYTKDVWKTEAANDNWDFSFFRYCNYFFEKVLPKYEAGEISGNADDVKHYIGEMYFIRAWKYFQKLRMYGDYPIITEVLPDNAEILIEKGVRQPRNKVARFILEDLDKAAEYMHDHGFAGNNRLNKQCALLIKSRVALYEATFEKYHQGTGRVPGDANWPGKRVHPDYKYDANTEINFFLDQAMSAAEQVADVIKLTPNSGVFNPANDNDISGWNDYFDMFSAEDMSGFEEVLFWRDYYSGDFTIAHGATAYVASGGNNGMLHNYVQSFLMKDGMPWYAATAAYPFKGDERVMDEKANRDERLQLFLFGEEDMIPAVSNAATNAMKTYQDANYPNIIVAESEIKDLTGYRIRKCLSYDQKQYVSGQAQSTTGCVIFRAVEAYLNYMEAACMKNNGNVTGKAAEYWRAVRIRAGVDPDFTKTIAATDLSKENDLAKYKGENEMIDVTLFNIRRERRCEFIGEGMRMDDLIRWRSLYRLLVERFIPEGFNFWGSDAYKRYEGEDAKFEYIEGPDNAMANVSSRKLSNYLRPYSVVQKNNEIYDGYTWAKAHYLYPVPIRQIELLSPSGEIASSVIYQNPYWPEERNTAAIE

SEQ ID NO: 10242 - protein, 840 aa, B.fragilis
CMKEKTNLFPSLIRLRETSRLKMAIAASIMLWCATPQQATADTNEEHAIEAVQQAKVKVKGTVVDETGEPMIGVAVKVLANNTGTITDLEGKFSVEAPLGGAIQISFIGYKTVTVKASSEPISVTLKEDSQQLDEVVVVGYGSQKKVNVTGSVSMVDSKVIESRPVQNVSQALQGVVPGLNMSVGNSGGALDSSLSINIRGAGTIGEGSSGSPLVLIDGIEGDMNTVNPNDIENISVLKDAASSSIYGARASFGVIMITTKSGKSGKTRVNYSGNVRFSDAIQIPEMVDSYTFAQYFNRANTNDGGGLVFDEAALERIKNYQTGKYTDPNTPEYYGAKAGNDGKWQNYTGSFANTDWFKEFYKNWVPSTEHNLNISGGTDKLTYMISGSFLDQKGLLRHGEDQFNRYTMNAKISAKLTDWVTLNYTSKWTREDYDRPTYMTGLFFHNIARRWPTCPVRDPNGHYQQKMEIIEMEDGGKQTSQKNWYTQQLQAIFEPIKDWRIVAEGSMRTYTRKQSWAVLPIYAYDADNQPYLLGWGDNAAGYSEVQDSRESEDYFSTNIYTDFAKTFGDHNFKIMVGFNGELYRPSGLTGFGTDLISPEVPSLGLTQDNKKASSWASEKAIAGFFGRLNYNYKERYMLEANLRYDGSSRFIGDKRWGLFPSFSAGWNISREAFFEPLTQVVGTLKLRGSWGQLGNNNTSETNAWYPFYQNMPTGSASSGWLINGKKQNVAGLPGIVSSLMTWETIESWNVGIDWGLFDNRLTGSFDYYNRYTYDMIGPAPTLPSVLGASAPQINNCDMKSYGWELELSWRDRIQQFNYGVRLVMSDNMQKILEYPNKTS

SEQ ID NO: 10243 - protein, 62 aa, B.fragilis
FRTISTSQTRQKRYYKITLIRQAYGVETKKTLKHHFRQDKSLPEKSQKTNYSNLCLTEQFSV

SEQ ID NO: 10244 - protein, 191 aa, B.fragilis
ATVDTSSPVVKTCLLSPHRNSPMNRVDIEEYLCRVFHLQRVLWLDHGYLSGDDTDSHIDTLARFCSPDTIAYVKCTDSEDEHYEALCKMEEQLKTFRTTSGAPYRLLALPMADKIEVEGERLPATYANFLIMNDVVLYPTYNQPENDKLAKEVLCEAFPTYEVVGIDCRALIKQHGSLHCVTMQYPTGVIK

SEQ ID NO: 10245 - protein, 202 aa, B.fragilis
KARLLIDPGEDSYRLVDLPNGEELRAQAQKEFNLTDSETKALANYKLYGNLDKGVVRGFEVNAATNLGAGFSLNGNYAYAYARGKSVDGVWGNIDRSVRHTGTVAGNYTHAWNDYMLNVNINGRFQSKRFHPGHSYGDAPGYGVWNLNVKHSLTGFQHLGLDFGMGLDNIFNKRDTRPNGVNYALLSPGRMAYVSLTLRFKK

SEQ ID NO: 10246 - protein, 1095 aa, B.fragilis
CSRFCHYKFLLYMKAYRLKITCFILLLLPVLTCCTDEELLRGSGVPEGVPTTVDISVGTAANRAKTRSGLPEGEERKIYDLYLWVFDSRGGVEFSREYPRAELYQAAAALETATGEKDTDAPTSMGLLKNIPITSGEKTLVLLANYKSDGDGLFQVEPGILAGVSSLSDIQRVKAEMTARTLFRPNGNLLMSVTKTEEISPDTRRLEVSLKRAEAKITINLKTGEGLTFVPGTWRVGNVPASTFVTEHVKGSDAGAPWDAGGMEMDSYWLSELFQFEGDATTTTTTFYLPENRKLAKKMITPASPGYNAERKGYDLRQKQVKSPVPDATEKPNVQNGATEYAPDLAPYIEFTGELRQDMTTGEVSTERFGRVTYRVYLGYTAENDPVNDYDIERNVHYTYNVTIKGMNDLVVEAMSDKDREEEPAPGVEGLVYDAHRSFSFDCHYEQGLMRFNKDELAIFNPDGSLKDDAMISFAIRTPFCDKIVSYTKAELEQLEDNGYVPSGEKKADTGWLAFFIHPSTLSDNGNETMEYYSNTGAHLLSLEQFLYRLVKEPDYVFNASTGLCKVTVYANEYFYERNPMRDGAPEDKNLWKTFANAPDRTFDLLVNTSHEISPDGQSRYHQAVVSIRQMSIKTVFTEGPEGMRVWGVENVNETPDLDFMVKAPGEPDAFYNKYTSNGWSNTWKVMARSGDFSQEVMIDPMRRSKQDQLWQVMTKVDNAKLTLSRDHYNLAAKNYHAEYACFTPFLRNRDDNRDGRMQAAEMKWYIPSVSESGMLLVGERALPLHSRLHGHAPSDNATAFYMSRAFMASTNLSLYSSNPYICILESRSVTPIANFDYYKGGNSPGDRTPYSEVRLIRDLGMLESGEESYHIEELGKELNKSLVNNRTKEEYLVFRADNLPYSMTRGVRAIYELPAHDEDSQSNTIYKNGFEVAKYIANKIDKPKDLNNPDRKSEYYLQDWSTLMADIEQGNSPCAYYYQEADKSDLGTWRVPNEVELIIMCGSLFDWHNPEKKEVYEFGNDLPSLGVVESEVLHSRTGFSKRSMNGARSFSAGYQMYLHGYLRWVTTVDTQWAGDNDRLVNNRKGYVRCVRDLE

SEQ ID NO: 10247 - protein, 89 aa, B.fragilis
IKISLQNYIWYIRVELFSMLSELIGNFMKKGEYLRHMRVFSSVRFPRGYSCVALYQEVVPFSKAMGLVLGSEIVIPEKVCMGRGPLVLE

SEQ ID NO: 10248 - protein, 136 aa, B.fragilis
KKMSKSSFLLDFKAFVMRGNVVDMAVGVIIGGAFGKIISSVVADIIMPPIGLLVGGTNFSELRWELEPARVVDGVEQAAVTINYGNFIQTMLDFVIIAFAIFLFIRLLSNLRRKKEETPFAPTCPEQRGKVTFRNT

SEQ ID NO: 10249 - protein, 93 aa, B.fragilis
RHIPEANSWQEGHPHPKIQLTVEYYTGGNISQTRTRTFLLDIGEESSPGVYSGPIYPNRDYKVFMVLPEAADREIIYRVESWERKDVEFPPFQ

SEQ ID NO: 10250 - protein, 176 aa, B.fragilis
LRAPGEERARADGQGACVYQIVKDKRIDDVEMTGQWETALAKIESGEMNPDSLRKAIEGYAAQITEELLQVQVSVADGGHIPCPKCRSGRILLYPKVAKCSNVDCSLTVFRNKGEKQLTDSQITDLVTKGRTALIKGFRSREDKPFDAYLTFDKDFRIVYGFPPHTDKSKGKEHRR

SEQ ID NO: 10251 - protein, 67 aa, B.fragilis
FFTTMKEYCVYWFENGEPRHEVFSCLDGAEMFSCMIRGQDGVEHVEISEEDISAPEEFREICPGDFS

SEQ ID NO: 10252 - protein, 721 aa, B.fragilis
LKRTLYTNAKADHMVRKEEILAKTGNGLEVFRHYLPVKWRVGRNFLNPLYADGRASCNVYYDRHSGMYRMKDFGNGEYSGDCFFLVAKLKGLDCRSAADFVEVLHTIDRELCLGLDGAIPSGTNNREGSCRTTRPVTGAREKSEGENTGESIPGDTVTGTEGKDLSRERPGPSPYQVAEKSFTERELAYWGISGITVEVLHRYGVVSLAEYRSETREGKTFGFTSTPAEPMFGYRGKWGVKVYRPLSEVRFVYGGHTGDNYCFGLEQLPSKGDLLFLTGGEKDVMTLAAHGFQAICFNSETSVIPAKTVRKLVYRFKHIVLLYDTDKTGLECSEKHRVQLSEYGVKRLVLPLPGTKSEKDVTDYFKAGHTREDLMGLFLKLLDTLYGDTMAVLKSCEIDYDCPPEQAVAIVTAGDVPLGSEENILCITGGEGTGKSNYTAALVAGAIMEREEDADLLGVKVEPNRKGRAVLLYDTEQSEQQLYKNTGRLLRRAGREKMPPYLHVYCLTGMSRNERLTAIIQSMDKYHYLHGGIHLVVIDGVADLIRCSNDEAESVALVDEIYRLAGIYRTCITAVVHFVPNGLKLRGHLGSELQRKSAAILSIEKDENPEVSVVKALKVRDGSPLDIPLMQFRWDKQAGMPVYMGEKPRVEKERRKEKELSEMARAAFVTQKKYGYIELCELIQETLDVKERTAKGYIRYMREKEIIEKEGDCYVYGQRKI

SEQ ID NO: 10253 - protein, 140 aa, B.fragilis
AIRTKDVGDNWRKPGQDFLVSKSFDVTLRDFTLIDEILKRVDTKGIHTMYIDKLEHRHILSYHRKGKIEALKAAREKAVYLLEAIGKRPGEIIRIVEGGDAGKEMFAQGHILSVAPPPFERSRTIKKRYSMLVRFGIVDR

SEQ ID NO: 10254 - protein, 292 aa, B.fragilis
PFAASASSTRRRCRSSSSVTTSPTPTSRCSGRRATWGTRRLVTNRAGEQVEALVSRNFKTNELVAFPLSKVNIPAEKNGHTFTPDEIARLKQGEAVVCQFLSRAKEGEQPKIYPAPVQFSAAKMQLEFLFGDRGKLAMDAYKTNLKQTANQEVPKTFRKQELTEKSRLELEAGGTVKVSGLVDKKGKAYQGYITWKPGEKPAFMFPKDYKAALEEGRVKPAVENEVQVAVNSEGKTVEATRNLKEALQSAQQRPTGEQKQQQERKQEQKEERKQSQKQEQPDKPKRSRGVRR

SEQ ID NO: 10255 - protein, 281 aa, B.fragilis
LRNNMIETYFNNLMQEVERKMGIESSRMEGEQVIRTCQEMVSFLRERSRELKDYVLNHPFSNVEEEICFFKYYKPALTGRLLYYYRVYQIESGCSCCPEIARMHYRKAMKEYQRKLERYLPFYQYYRSGATYRDHYYFRRAKKELSPESGSFMLEEDSVMSTGYDLLAARLIAAEMLLGYLNRKVLLAMEGAYAVQEKEHHWTDRKAAAVELIYGIWAMGSVDNGRVSIVELVMLFEQMFHIDLGDVYHTFISMRNRKNSRTAYLDQMKERLLKRMDETDG

SEQ ID NO: 10256 - protein, 415 aa, B.fragilis
SGCKIGPVSTIFSPINRIRKMKAPRKIYTWTSILLFVCCSLIFLSCEKEELGEAMENRKTLFMFLPWSTDLTGYFYTNIADMEACVSRRGLEHERILVFMSTSSTEATMFEIIHSKGKCDRKTLKRYGTSGFTTVEGITGILNDVQEFAPAPVYAMIIGSHGMGWLPVDGTQADSLFRMKKHWEYQEQPLTRYFGGLTREFQTDVGTLARGIVGAGVKMEYILFDDCYMSSVEVAYELKEATRFLIASTSEMMAYGMPYATVGEFLLGNPDYGSLCEGFHDFYSTYEMMPCGTLAVTDCSELDNMAAIMKSINDRYVFDDSLQGELQGLDGYTPVIFYDFADYVLTLCSDPVLTARFREQLERLVPYKTHTGKFYSRTKGPLPIHTFSGITISDPSTNPMALLKGTTSWYKATHE

SEQ ID NO: 10257 - protein, 85 aa, B.fragilis
HAAKVFFLVQKNRRGALFGLSTVAIYCIFTKWRIGKGDLATCYEPASLFLVLQKVIRPFRPFVSTNVPSFDQGKLSGCSSGYAWR

SEQ ID NO: 10258 - protein, 232 aa, B.fragilis
NAMNRYVSEMIGTMVLVLMGCGSAVFAGDMPGAVTTGVGTLGVAIAFGLSVVAMAYAIGGISGCHINPAITLGMYCSGGMGGKDALLYIIFQIIGGILGSAVLFILVSTGPHAGPTMTGSNGFVEGEMLQAFIAEAVFTFIFVLVALGATDKKKGAGKLAGLVIGLTLVLVHIVCIPITGTSVNPARSIGPALFEGGGAISQLWLFIVAPLTGGLASAIVWKAISQHSDRQR

SEQ ID NO: 10259 - protein, 378 aa, B.fragilis
HNMNFEQLATIIADTHQRLQQSAVKAVNQCQTMRNWLIGFYIVEFEQNGEDRAKYGEFLLKNLEQKVNLKGLNITLFKRSRVFYMVYPQLATVIKTILPPTGASTMHLLEMQGLGKSASLMHLLQNAENKQDIVNTIEPQKLLSSISFTHFIELVKIDNPIKRMYYEMLTIQTGLSVRELKRQIGALSYERVGLSGNMENALAAIQQKIHPQTVTDAVKDDYFFEFLNIPQQRASLLKEKELETLLLDHLRDFIIELGNGFCFEARQKRILIGDEFYFIDMVFYHRILKCHILCELKVDTFNHAHVSQLYSYLNYYKAEVMEPGDNPPIGILLVTDKNDALVRYTTTGLDEQIFVSKYQLQLPTEQQLKELILKTIRQ

SEQ ID NO: 10260 - protein, 120 aa, B.fragilis
KLNLMMKKIFISLFLSGVFMYHTNAQTAVEGNKFLDNWSIGISAGGTTPLTHHSFFGNMRPITEIELNKQLTPVFGFGLEAVGSFNTSQSRTIFDRSNVSLLGLENLNNLLGTYTGVPRP

SEQ ID NO: 10261 - protein, 138 aa, B.fragilis
KIMEIIAIESIAFATLVEKIEGIAAYVQASGTKEREQWPVADKKGTRKAGLWMTGKEVCEQLEISPRTLQRYRTNRIIAYSICGRKIRYRRTDVEQFHERWIRETPDKLVDRMIEAYPLHQCKSRSYGKKRGNTGKNR

SEQ ID NO: 10262 - protein, 143 aa, B.fragilis
RNGRRRGTSVTCGKRKLLKRRATAMYMDSEKFENWMERIMERFDRTEKLLERVLKKSNALDGEEVLDNQDLCLLLKVGIRTLQRYRAIGILPYFTISGKVFYRVKDVHEFLRNQFAAVEERAAKRKEKEVRKEERRRKKGLFP

SEQ ID NO: 10263 - protein, 235 aa, B.fragilis
FNLRESKAWTLALKPALVYDMNAMGSEAVRFHSGRAVWEISVGLKYHFGCSNGKHHFTKVRAYDQQEVDVLNAKINELHTQAGKDAKALQEAVRKVTELEAALDKCRNQEPKIVKDTIDNTKKTLESVITFRQGRTTVDNSQLPNVERIATYLKNHKGASVLIKGYASPEGSVEVNERIARQRAEAVKKMLVGKYGIAEERIVAEGQGVGNMFEEPDWNRVSICTINAGTESSSR

SEQ ID NO: 10264 - protein, 91 aa, B.fragilis
TVMRVFNLLLLISMFSPIPLPAQVGERYIEVAGTSEIEVVPDRIHYVIEIRQYFEVEFDGVSEPEEYRTKVPLTRIEEQLKQVLTIVGVPR

SEQ ID NO: 10265 - protein, 87 aa, B.fragilis
PVNRLIDSTHDKMKDYYFIMNAGVKAGGEITHAVLEGKIVSAPKGYDAFTGIEAAREKLACGNIRQQMEEFGIELEIVPVNTDFLLR

SEQ ID NO: 10266 - protein, 143 aa, B.fragilis
EGAGVRTERRQDMGCTVERSAGGRENPNGVREDVIKKQPADLGIIKEAWQVLLIAKITEIVGTTNIRILQMRNYVLRICYYCRIVFKINSFNCCSVGSCNWYLETNICSSNPVVVYRTNASFLSVTSKMPIGGLSPGSITSAL

SEQ ID NO: 10267 - protein, 98 aa, B.fragilis
NSDMTKADIINRVSEELGIDRRTVGLVIESFMKCVKDALGRERIVFLRGFGTFSLKKRAAKKAQNIQQHTTICIPARKVPHFKPSESFLVLRKEDNRK

SEQ ID NO: 10268 - protein, 81 aa, B.fragilis
QVRITCSPSIREDSMPILRSTSCIKLLKYVSIMLFLNYGAREYLHATRFIFMPRLIRSQVFLSALYDEKTFPHIEKTGEKP

SEQ ID NO: 10269 - protein, 546 aa, B.fragilis
RNMITAVIAEKPSVAKDIANVLNVRERHDGYLSGNGYLVTWAFGHLVQLAMPEAYGYAGFRRENLPILPQEFKYIPRQIREGKEYKPDPGVLKQLKVIREVFDRSDRIVVATDAGREGEAIHRYIYNYLGCRKPCLRLWISSLTDRAIREGLDNLKIGSDYDNLYRAAEARAIADWEIGLNATQALSIAAGQGIYSLGRVQTPTLMMICSRYLENRDFTPQTYYRLKVTAEKDGTPFAAISELRYETLPAANAALGAVTATGTVEVADLQRREVSQEPPLLYDLTALQKEANGRYGFSADKTLSIAQSLYEKKVLSYPRTGSRYLSDDVFDEIPDRIALLERYPAFAAHAAALKGASLNRRSVDAGKVTDHHALIITECLPGELSADERTVYDMVAARLLEAFSARCLKDATTVSFTAGNSVFTAKGTVVRSAGWRAVRNEREEDDEGTAALPTMQTDEAFPLQSAECVEKQTKPRPLHTESSLLSAMEHCGRELQDDELRDSLKGNGIGTPATRAYIIETLYARDYVRPEKKELVPTDKELACIK

SEQ ID NO: 10270 - protein, 517 aa, B.fragilis
FFQIMDEQPDSSQQLMDILLVMDEKGTLQAVSGVKDGELQTKNPLEDNNDLLRVDRHGDMFSNFFSNLWSQLKDPTRFHFFRVPEEQVQRVPADFRQRESRSVKTGEPLLAQYEVQPPVQAQQQTQAGQQQQPEDAPQQSAGQTEQNPQYKYRPEDIDWNSLAALGVQREQIEGNGMLDQMLRGFQTDKTVRVHFHFEGISHSNDSQLSLKPGTDGRLTVCSLGILDPEKMQKQFFGYDITDSDKQVLRQTGYMGHPATRHQPGGRAGRSPCQPQLQDQRAGRFPALQGQYPGGEERAYLHPGRNSPAQTGRGGGLPVPFQSQGGGATQDLPGSRTVQRSQDAARISLRRPGQAGDGCVQDEPETDRQSGGAEDFPQAGAYREVSPRTRSRGNGQGLRSGGQERKSLPRLHHMEARREARLHVSQGLQGGTRRGACQARRGERGAGGGQFRGQDRRGDPQPERSPAIRTAAPHRGAETAAGAQAGAERGTETVTEAGTARQAQAQPGCPPLISPATL

SEQ ID NO: 10271 - protein, 165 aa, B.fragilis
KHIVMKQITLHVYQSIDGCPVIADKCFNAVVDACAYVLIDEETYLRIYLNDLDWPLEAKETLVVTNGCIDLTETERVRFVRGNVVTELQRIKENGDGMVVAYGGETGVLLLDNGLADEIVMTTVPVLVGNSEKGLECGPNDGRIWAVRSSEVLEDGKIRTVYGRM

SEQ ID NO: 10272 - protein, 69 aa, B.fragilis
HMSVVESINFQFAQNMTFQNPVVEDHINEIKFVTDKDSFLSGFETEAVSEFDNEVSQMVEQKCFEFLLL

SEQ ID NO: 10273 - protein, 163 aa, B.fragilis
VMNTLTSQIEQLQSLAHELLYLGVDGAPIYTDHFRQLNKEVLEQSDALYPQRGATSEEEANICLALLMGYNATIYNQGDKEEKKQVVLNRWWDVLDQTSGTLLKCQLVTYCYGGGVEEELGKEGPSFIKKVERIRNFLKIKKRQLIILRKLGKKILFSMGKGK

SEQ ID NO: 10274 - protein, 174 aa, B.fragilis; identical to SEQ ID NO: 9414

SEQ ID NO: 10275 - protein, 122 aa, B.fragilis; identical to SEQ ID NO: 9429

SEQ ID NO: 10276 - protein, 308 aa, B.fragilis
TSLLLTQKAILMKKTIFLILCILCSLGAMAQKKSITGVVTDASGESVIGASVVEVGTTNGVITDISGKFTLMVDPNGKIKVSYVGYQPQVLDVKGKNSFNIKLKEDSEMLDEVVVTGYGGKQLRTKVTNSIGKVKEDVLQKGLFSNPAQALSGAVSGVRVLQTSGDPGATPTIILRGGTDYNGTGSPLVLVDGQVRGSLSDINPEDIESMEVLKDAGATAIYGARANNGVILVTTKRGKEGKGEVSVKAKVGINYYNNPYEFMNARDYIYWMRTAYQRSGQIYKDSKGNWVGTADMNSLNNATSLWYG

SEQ ID NO: 10277 - protein, 268 aa, B.fragilis
NSNKLVHPDVHFVFPVVKNGRSDDYIVEWRKLVLNNPYFTINHWLNEINAENAQAVIYTKESDEIMKKLSLKSSEGGFKITLLWLPEKMQQACANKLLKLLEEPPEKTIFLLVSEAPDLILQTILSRTQRFNLRKIEEECMAEALQSKYGVQQATSISIAHLANGNFIKALETIHLNEENQLFFELFVSLMRLSYQRKIREMKLWSEQVAGMGRERQKNFLEYCHKERFKSLPGRPVNDFRNYMTLEEQNFATRFAVFTTGLGGSTLV

SEQ ID NO: 10278 - protein, 73 aa, B.fragilis
LKIAIKSIKVCSFVYSFRRKLNRRKIRQFSLAAQYLKIGNMPIMLYYPFQKGLIIHARNGNSYHGTKSVAYFI

SEQ ID NO: 10279 - protein, 559 aa, B.fragilis
IMKAKKYNWTLRHSFLLFLVIFISSSCVEDVTESTKEPTRYTANDIKSYSDLFDVFWNTMNQKYNYFYEQSSFNWETVYNEYAPKFKKLKTFNRDKQYSKAEISEDCNKAIEYFTEIIDPIIDRHFYVKISLPVSHSFIRNVYFHGGMKSKEKIYTYPFELKYEYMRSKIQSETGVFGQANDMLGGFLSDNPDIYYFSFKSFTISNHYILSFGSEYLVIDDKSPYYLTEKEIRDTVEANKIKDPAVKSALIEKSIEYMNKFNSFMRSEIAQDAIKKIADFNQSENPDNSFIEALSKAKENAPDINIELSQLSGLKEFRLNPNYTTWFKQRSTEHLQLACEYTVFLSNIDNVINNQYKIDFYRNFLVPLKVGKIKKIILDLRGNGGGMVLDARTFTDRFITKDAIFGYQRFKEDNNPFSYTPWTPCMTKTTGIGIKKEIPIVILLDNNSASMSEISTLMLKSQGKHVTVVGGYSAGATAGLGDSDQFNGGIRGKVSDYLEFYMPLLAMQDATHTVIEGIGIKPDLLVDPLTEDEVREMALSPFTHIDRTLKQAIEVLSNN

SEQ ID NO: 10280 - protein, 171 aa, B.fragilis
CFNFMKKGILFIALFAASFGFMQSSFAAPSMSANSITNVLAISDYEGTYSGTMDNIIMRGKPYESRAATYKIEGGRLKCDFPQIGSMPGTITISLAVEVDEETGEITAYNGDEAGTLSLPLGIKVKLYLDDLRDAKITDNGSSKQIEFTLDVSGTFLGANFPASVHFVGTK

SEQ ID NO: 10281 - protein, 84 aa, B.fragilis
TLKKRPMRKLKKPYSQNWRGLSAKWLFILSTVLGIIAGTCFWIFISRCGNEECFLNYDPLPEMFIGGVIGAFLYVIIWGMTSDM

SEQ ID NO: 10282 - protein, 498 aa, B.fragilis
RRMKRVTTILFLMLLICVHTAAQQKVKLEVLEKGTEQPIIAANVIYADNEALRNPQYAITNTSGQAELKLPSKGICYYKVTYIGYVPVTGKIGGTQDEKVIYMKEDDLGINEVVVTGSRTARPIKMSPVTTQVLGGKALVDAGYSNLQQALQQETPGLNIQKVGFGNEISMQGLDARHVLFLMDGERMTGDMAGNLDYERFNLHAIDRVEIVKGASSTLYGSRAAGAVINLITKKTDKPLSIDAGIRYGQMNERNYKHPQPKDFLYMFEQNADRPNLQSWVSAGFKAGKFTSQTDVWYSESDAFYMYQAENDKKVYTKEANPFLPHDITVVSNAVRPPMGIEGKEHITVSQKLYYNPNPNLSVLVYGSSFFMNTYDLIQDMMFSQARDLTAGTKVTYHVKDWFSVTGSLHADFYDRFKRHERIDKRQKDYESSIYQPRLTVTSNYFNGHSLILGMEHTSDELTSDRFSGNANHDLKTRALKETEYFLSSLMAERPSFP

SEQ ID NO: 10283 - protein, 60 aa, B.fragilis
RPFDKLERLSSSPVVKTVDQENIDSILFCIEENNSTLKALREETNAQKLGNKTGIYSVRP

SEQ ID NO: 10284 - protein, 65 aa, B.fragilis
FIYCNPIGEVWGTCFNPAALLLLTSFSSIVVCSMFYFFLQVSVEETNKRKSFINYIKRKLKCIIK

SEQ ID NO: 10285 - protein, 931 aa, B.fragilis
FCVCLVFFGMNIRMNILLCFLWLFSATLSAQQVKIVKGHVCVLSEDSIERSLPYASVVVLEGKDSAFVKGMASDANGSFKLEFIPQKRMEYLLRISYIGMSTIFRKLDPHMMDIDCGHILMESGIKLAEVLVTAPVKEIDMAGDTTVINADAYRTPEGSNLEELVRKIPGLEYDDRSKSLSYNGLVISEINVNGEAFFSGNHVLALENLPADLISRIKVYDKRSEMEKFTGVRTVDENYVLDLQTKKELNGTLITSVAVGKGNKKKKEAELISNFFKADGENLSVIAKSGNRDITTENKKNRQDNIAVNFLKKFGETVHINGNIMYNNAINGINGTSYYEQYLMTGNRYRYATDNGYHTNRMISAMLSARWNIDKKTLLNISGSFNALKGINDDSNRQATYNADPKLDVTSPFNRDASEQIEDSIRVNDICMTSRSSSINRLYSIGADITRRLNAKGTSLGLTVQYSEERGNNKAFSLSSTTYYQLQNVKGNDSILYRNQYQESPNRNRTIKLGLILTQILRKNLRAQLSYIFKLDNQSRDRNTYVLSPVVDGEEHTPTGNFPKGYEVEYTDSLSNKSRSHTMAHGVSLNLNYTDKTWEITTGLSVTPKRQTLGQKTGWTQADTLRYSVNYHPTLTILWRKRKTWVQLSYEGNTQQPGLAELLTLTDNSDPLNIIRGNPDLKSSYTQKVRLEVRDTKTGLSGDVNWTSMLNNVTRAVIYDSQTGGIESRPVNVNGNWNIKAAMRYQKRINHYFNLSARTGTSFIQSVSLVNDGQREQPERSVTHNRLYNAGLRVGYQPKWGGFDLSGDWRFRHSTNLLRETNNYIRDYSFGLTAYAVFPGNIRLKSETTHTFRNGTNINRSEDNEVVWNLHLSWSFLKYKKAEFSVYWADILSQKKSYSRNVTSHGLSERYTQQIGSYFIVSFKYRFNRQL

SEQ ID NO: 10286 - protein, 278 aa, B.fragilis
INLLLEAKQYCIDLVYYNGLKKELKVRLRHAQAIADAYRQRLDRGDASILEYNKVQLNLSTVQGEMSRIEVERNALLSELKRLNGGMDVIFEASNYSPASLPVNFEDWYLSAQQKNPLLQYVKQQIEVSKEQVKLGKAMTLPKFSAGYSLERTLGQKYQGISVGISIPLWENKNRVKQAKAGVVAAQAREQDSKQQFYDRLRNLYMRASGLQQTAIAYRESLKALNNTALLMKALDVGEISLLNYIVEIGLYYDTVNQTLAAERDFEKALADLSAVEL

SEQ ID NO: 10287 - protein, 249 aa, B.fragilis
QTIGSMFNLNINFMKKQLVIFILLGIIAIPSSVKAQKLKVSLSAGLSKSILNSDVSNLVNTRYDTKTGVATRVNLEYNFFKDFIVGTGLGFIQKNYEYKKTDNITGTHTLYKNNFMDIPLNVGLYLFNNPHKENGIWLKVQGGVFYEYFTRMHRKGEYPIFAQLQEDGSYIKAQVNETYDFKRNENNLKRNLFGIEGTGEVGYSFNRIDVFASYTYQYGLTDIYKAKTSSNRKSKRISNIISLGVAYKF

SEQ ID NO: 10288 - protein, 228 aa, B.fragilis
KKIIYKLYKKKTEMYNKIRFDTFMLMCFFMITILGLSACDSDEKITQEPPSQTYVKKAKEILAGDIVLSTRATMNGVDKTLLKSGCPTKFNFSWREDGMMILNLSDFSVGAMPFAISFKCATKIMQLNSWEQDEYPGDGWIKFVGTDGNVTTSGDDAEDNQEGSGARVDGYLNVNTNQIEFIVDYNMMNVRTETFLQTIDKTRIDRFKEEFAQYEKDLEEAKKDQGKA

SEQ ID NO: 10289 - protein, 475 aa, B.fragilis
CNEMNNLRNYLGLSALTMGLCLMSCNDDNTPSYSQTTMKNSELKTILQQKGYQFNEQGNLLLDDLANNTTTLDLSGTKLSNLSELDILPNLTEVKLSDNDYGPVFDFSKLPKQITGIDLTGNDIYDYDNLVNVVVEENGNETVTNLHDITKLYLPRTAKDNIKDLVRFYIKNKDAITNGKIDMKIKDESGTLQTYTTLREVPDENLRTYLQANFSDLFNGDQIDLSKHLGYAQKTTILLIQANAGVTNFEGIQYIIQNPYWEGAAVALYSAAQSGANMPSVKLGKYVTNLVLNNLNVRSLDLSNAGSLFVLNIGTVAGLSTLDLTHTIWGQREKEIEAEESKGSYLIVYDCPSLKEIKLPKKDELKTCFLDLECLDALETFDISNLKMVKNLIFGNLPENFNLVYPELTVFYSPEGRSATSFCCSESTFNRESTKTFLDRYYTKGTGVEKLGFSISMSCNKNDGYNWRKALKKKS

SEQ ID NO: 10290 - protein, 77 aa, B.fragilis
RQSSHGYNAFYRTRHLDGIPFNKSFKFDIEMLGWKRGEADYATTIYWYGDPEAQVFGTSGIEEARRQLLPAVEASAD

SEQ ID NO: 10291 - protein, 394 aa, B.fragilis
LVNMKHERPCLVASGSDWLQEVLRRLLVWVVVLSSGTLMAYAGNLDISQTKVITGTVTEKETGDPLIGVNVSVKGTSKGTITNLNGQYSVDVNSDKDILVFSFIGKATQEKAVKGLSHIDVVMADDATMLGEVVIQTGYMTQRKADLTGSVAMANTSDLAQNPSTNALKSLQGKLPGVFITTDGSPGGNASIQIRGLTSLNAQPNPLIVLDGLAGDYNLRDINPANIESIQVLKDAASASIYGSRAAGGVIIIETKKGKKGESKISYEGRVQFSKWVNKPDLLNTDEYGRAIWQAYANDDKLGEIKQSVRFFDYDWSYDSNGYPVLNSVKPVEWLNTAQTMRSADTNWIDEISRTGVSQNHQISVSSGTDKSRTFFNLGYENTEGIQIETFWKN

SEQ ID NO: 10292 - protein, 63 aa, B.fragilis
RQVSSLHCDTPMVYRGASGLHETSSPDSISPSKKSIRFMVGYYIKGSGGKYNNFPPESPTCLV

SEQ ID NO: 10293 - protein, 393 aa, B.fragilis
EMETFYRTHAYLVEHTNAPVRRDLMDEINWSDRLIGIKGTRGVGKTTFLLQYAKEKFGTDRSCLFINMNNFYFSGHSIVDFANEFQKRGGKVLLIDQVFKHPDWSRELRMCYDRFPNLKIVFTGSSVMRLKEENLELRDIVKSYNLRGFSFREFLNLQTGMKFRHYTLEEILSSHEQIAKGVLSKVRPLDYFQDYLHHGFYPFFLEKRNFSENLLKTMNMMVEVDILLIKQIELKYLSKIKKLLYLLAVDGPKAPNVSQLASDIQTSRATVMNYIKYLADARLINLVYPKGEEFPKKPSKIMLHNPNLMYSIYPVKVEEQDVLDTFFVNTMWKDHKVHKGDKNTSFMVDEVMPFKICCEGAKIKNNPGVTYALHKAEIGRGNQIPLWMFGFLY

SEQ ID NO: 10294 - protein, 492 aa, B.fragilis
EDRAGRGTSLLFLFLLSLLPLHAQTSPKHEVRAAWITAVYGLDWPRTKATTPAGIRRQKEELIDILDRLKEANFNTVLFQTRTRGDVLYRSDIEPFNSILTGKTGGDPGYDPLAFAVEECHKRGMECHAWMVTIPLGGKKHVASLGKQSVTRRERDICVPYKNEYFLNPGHPATKEYLMKLVREVVSRYDVDGVHFDYLRYPENAPRFPDSYDFRRYGKGRTLAQWRRDNLTDIVRYIYNGVKAMKPWVKVSTCPVGKYRDTSRYSSKGWNAFFTVYQDPQGWLGEGIQDQIYPMMYFRGNGFYPFALDWQEQSNGRHIVPGLGIYFLHPDEGNWTTEEVERQMHFIRSNRLAGEAHYRVKYLMDNTQGVYDLLLDHFYQYPALQPPMPWIDNVSPTAPSALKAVSAGDGYTRLNWKAATDNDKQNAPMYVVYASDTYPVDITNPENILVQNLRDTHYIYAPIRPWTARKYFAVTAVDRCGNESKAAQQEEK

SEQ ID NO: 10295 - protein, 301 aa, B.fragilis
KLIHTMNSIIVGMGEALWDVLPEGKKIGGAPANFAYHVSQFGFDSRVVSAVGNDELGDEILEIFREKQLKHQLERVNYPTGTVQVTLDNGGVPCYDIKEGVAWDNIPFTDDLKRLALSTRAVCFGSLAQRDEVSRATINRFLDTMPDMEGQLKIFDINLRQNFYTKEVLRESFRKCNVLKINDEELILISRMFGYPGIDLQDKCWILLAKYNLKMLILTCGTNGSYVFTPGTVSFQETPKVPVADTVGAGDSFTAAFCSSVLKGKSIPEAHRLAVEVSAYVCTQSGAMPVLPEALRNRLND

SEQ ID NO: 10296 - protein, 768 aa, B.fragilis
TKNKPNKRTTHRMKSMRSIHSLIRCCMILLLLTSCYSKEERRVLVIHSYEKDYQGYAEFNKLIKKEFAKAHIPVELTFFYLNCEINNEQQEIDKINNFLDSISKWKPEVLLVNDDQATYSLLETHHPLLKGIPIVFSGVNYPNWELIGQYNNVTGFHDKIDFRKNLEMVHKLTGKNHIYTILDFTFLDRKVRNDIDNQLKSTDIISNLDWHLDKNDTRKEAEKGHIIINALSARNLSKNQNKDQTKGGDFIWSISKYSTLPYLQTKFDYTTVTMASLSTRQRFTTINELFDCGRDFLGGYITPMHIQVEESVHAAARILNGENVADIPIQESAKGYFIDWNAMQKEHLTIADIPHEYTIINIPFKTRHPIVWWFALLGSITAIVSLLSGITYLYWRETKRKRSILYELEDEKESLALAVEGSDTYAWRLKDDTMVFEYAFWKNLGMAPHPLTIDGFLSFVDADYLDTTQALLTKNATNGKHFIKLKCDFNGTGYQWWELRCSTMKSALGGQKTTGLLLNIEDYKKREQELIEARKMAEKAELKESFLANISHEIRTPLNAIVGFSTLLASPDDTDITPEEKEQYIDTINRNSELLLKLINDILELSRIESGYMSFDCDDYPLDALIRDTYQTHKILIPGQLHFLLEEGEKGLIVHVDKNRLVQVITNFLNNASKFTREGSIKLGWSYMPQTEEVEIYVEDTGIGIPQSEQKMIFGRFYKQNEFAQGTGLGLSICKLIIEKLQGRLSLRSEAGTGSRFSIFFSCKKQSI

SEQ ID NO: 10297 - protein, 282 aa, B.fragilis
NHSKCNRIMINIGQYIETLINWMMIHFSTFFDALNLGIGSFINGFQHILFGIPFYLTIAAMVLLAWAKAGRGVAVFTLLGLLLIYGMGFWEATMQTLALVLSSTCLALIVGVPIGVWTANSNRAEKVIHPILDLMQTMPAFVYLIPAVLFFGLGVVPGVFATIIFAMPPVIRLTGLGIRQVPKNVVEASRSFGATRWQLLYKVQLPLALPTILTGVNQTIMMSLSMVVIAAMIAAGGLGEIVLKGITQMKIGLGFEGGIAVVILAIILDRITQGMVRRKDKK

SEQ ID NO: 10298 - protein, 285 aa, B.fragilis
DMRKYRIIGSLLLLAVMCVACNPDSGKKKISIAYANWLEGIAMSHLAKVVLEEKGYEVELLNADVAPVFASVSRKKADVFMDAWLPVTMKDYIDQYGDQIEFIGEVYDSARVGLVVPQYVTIDSIGELAAYKGQFSSEIVGIDAGAGIMKTTDKAIGDYGLDGYKLLTSSSSTMLASLQKAMEKEAWIVITGWTPHWMFDRYPLKFLHDPKGTYGNVESIYVVGWKGFTEKDPFAAKFFSNIKFTTEEISSLMKALKDARMDEEDLVRKWRDEHRELVESWIPES

SEQ ID NO: 10299 - protein, 909 aa, B.fragilis
PTMNRILFLLGLMLSGLLVSCSPDAPRYTIGVSQCSDDTWRHKMNDEIQREALFYGGVKVETRTAHDDSRRQIEDIRYFIRQKVDLLIVAANEGMALTPVVEEAFDKGIPVIMVDRRILSDKYTAYIGADNYELGKAVGNYIAHRLKGRGKVVELSGLVGSTPAIERHQGFMSAISQYPDMTLLASEDAGWLQQPAEAKMDSLLQRFPEIDAVYGMNDRMAAGAFRAAGRRGREKEMIFVGIDALPGKGNGVELVLDSVLDATFIYPTEGDKVVQLAMDILEKKPFERETKLKTAVVDAVNAHVMELQTNHIGELDGKIETLNDRVGIYLSRVATQRIVLYGGLIILLLIVGLLIVVYKSLRSKNSLNRELSRQKEQLEEQRDQLIELSHQLEEATHAKLVFFTNISHDFRTPLTLVADPVEQLLADPSLEGDRRRMLLLVQRNVQILLRLVNQILDFRRYETGKMEFTPVPLDLLQCFVGWNDSFQAAARRKHIHFSFDSVPDTDYHTQADAEKLERIYFNLLANAFKFTPENGKVTVRLAALQKDGAPFFRFTVANTGSLISAEHIRSIFDRFYKIDRHHTGSGIGLALVKAFVEIHGGSISVESDERLGTVFTVDLPVRTCEEGACVVTAPMEESAPDRVDSLLREDEAENLNDPSKPSVLVIDDNADIRAYVHTLLNSEYSIIEAADGTEGIRKAMKYVPDVIISDVMMPGIDGIECCRRLKGELQTCHIPVILLTACSLDEQRIQGYAGGADSYISKPFSSQLLLTRIRNLIESRQRMKQFFGDRQTLAKEDICDMDKDFVERFKSLIEVKMGDSELNVEDLGKEMGLSRVQLYRKIKSLTNYAPNELLRMARLKKAASLLASSDMTIAEVGYEVGFTSPSYFAKCYKEQFGESPTEFLKRSGL

SEQ ID NO: 10300 - protein, 214 aa, B.fragilis
TKMNRFHHRVTQSLTEFKFLVHRMFKRKIFSVRLCVTLWCPPKNGIIMNITIRPTRLEELGQVMPFYERARRFMATNGNANQWINGYPSPDDIRQDIENGSSYVFVNENQELEGCFAFIRGEDPNYKVIKDGAWLNDAPYGVIHRIASGGRVKGLMDLCLEWCSSHCPNLRVDTHRDNKVLQNILLKNGFTYCGIIYVKNGTERLAYQRTAVTR

SEQ ID NO: 10301 - protein, 281 aa, B.fragilis
RHVNPGCYFGGSATQYFIGDFDGEKFVCDNKPETVKWLDWGKDHYATVCFSNTGDRTIAVPWMSNWQYANIVPTRQFRSANALPRELSLYTQDGDIYMAAAPVEETKSLRKESREIPAFEVGDAYHVDSLLSDNKGAYEIELELAAGSAEIMGLKLFNEKGENVDIYISLPEKKLVMDRTKSGIVDFGKDSAPHAIEAHDRRKQNSINYVDDFALGTWAPVQKAGNYKLDIFVDKCSVEIFLNGGKIAMTNLIFPTTPYNQMSFYSRGGAFKVDRCKIYRL

SEQ ID NO: 10302 - protein, 390 aa, B.fragilis
HIMENTKNNSYMKLIPVMLCFFAMGFVDLVGIASNYVKADLGLTDSQANIFPSLVFFWFLIFSVPTGMLMNRIGRKKTVLLSLVITFASLLLPVFGDSYLLMLVSFSLLGIGNALMQTSLNPVLSNIVSGERLASTLTFGQFVKTIASFLAPYIAMWGAIEAIPTFDLGWRVLFPIYMVVAVVAILLLNATQITEEPEEGKPSTFGQCLALLGKPFILLSFLGIMCHVGIDVGTNTTAPKILMERLGMTLADAGFATSLYFIFRTAGCFLGAFILQKMAAKTFFAISVLCMLAAMFGLFVFQDQAMIYVCIALIGFGNSNVFPIIFSQAMLYMPDKKNEVSGLMIMGLFGGTIFPLAMGVASDAVGQSGAVAVMLVGVLYLMFYTWRIKK

SEQ ID NO: 10303 - protein, 124 aa, B.fragilis
RNSLYKSNTSMKDYKENKSNLSETFCNEVYSVVREIPAGSVTTYGDIAALLGMPQYSRMVGRALRQVPAGLNLPCHRVVNAIGRLVPGWDEQRRLLDAEGVSFRKNGCVDLRLHRWRDDSVLAD

SEQ ID NO: 10304 - protein, 412 aa, B.fragilis
TLLCMSKITIKDLYLIFGNDKQHALRMLKEEKSKSEILKATGCTVAVKDANLSIREGEIFVIMGLSGSGKSTLLRCINRLIKPTSGEVIINGRDISNVTDKELLRIRRKELAMVFQHFGLLPHRSVLHNIAFGLELQGVKKQEREQRAMESMQLVGLKGYENQMVGELSGGMQQRVGLARALANDPEVLLMDEAFSALDPLIRIQMQDELLTLQSKMKKTIVFITHDLNEAIKLGDRIAIMKDGEVVQVGTSEEILTEPANAYVERFVQSVDRSKIITAASVMVDKPLVARLKKEGPEVLIRKMLERNLTVLPVVDVNNVLVGEVRLKDLLRLRQDQVKSIESVVREEVHSVLGDTILEDILPLMTKTNSPIWVVNETREFQGVVPLSSLIYEVTGKNKQEINEIIQNAIEL

SEQ ID NO: 10305 - protein, 102 aa, B.fragilis
ALAGSVRISSEVPTCTTSPSFMIAIRSPNLMASFKSWVINTMVFFILDCKVSNSSCICMRIKGSRAEKASSISSTSGSLANARAKPTRCCIPPDSSPTIWFS

SEQ ID NO: 10306 - protein, 192 aa, B.fragilis
HQILNIMDYEKLEQLKRLHDSGALNDEEFEKEKKKILDEEATAKPTAVLPMGLTENAYLALMNFAMFIPYVGWIAPIVFWIMGKENSILVNRQGKYILNWYISWFLYGIALTVLFVIFMFSGILSINDMDYANDQTSPLAVLLGIFGGGAGILLLLILGIGCFLCLLFPIIGGIKGLNGKTWKYPLSIPFLK

SEQ ID NO: 10307 - protein, 398 aa, B.fragilis
LMLMTNLLYLFNPDQDLALASGEVNYMPPASARRMAEELALLPVWFADGPCSVLAPSAYNQSFLEEMLDLFPLPASLRTQAEDFSEVRSVVPWGWNPALRKRLLSLGVPDAALPSMEDIGRLRDLSHRLQAVRLLSGLQVDEVFCGESCYLTALSDCRAFVESLERCLLKAPLSGSGKGLNWCKGAFTPLIERWCARVIEQQGGVVGEPIYNKVEDFAMEFYSDGKGRIIFAGYSLFRTNAGGAYEGNRLLPDAEIERRLSAYVPVAALHRLREELQRRLSVSLGTEYAGYLGVDMMICRFALLPEFRIHPCVEINLRMNMGLVSRMLYDRYVRPGAGGTFRISYHPSDGQALQEHDAMTVAHPLHTRNGRVVKGYLPLVPVRKSSRYRAYILVETGG

SEQ ID NO: 10308 - protein, 1193 aa, B.fragilis
ITYLNIIFIMTKQKKFITCDGNQAAAHISYMFSEVAAIYPITPSSTMAEYVDEWAAAGRKNIFGETVLVQEMQSEGGAAGAVHGSLQAGALTTTYTASQGLLLMIPNMYKIAGEFLPCVFHVSARTLASHALCIFGDHQDVMSARQTGFAMLAEGSVQEVMDLAGVAHLATIKARVPFMNFFDGFRTSHEIQKIEMLENEDLAPLVDQEALAEFRARALNPMNPVARGMAENPDHFFQHRESCNNYYEAVPAIVEEYMNEISKITGRKYGLFDYYGAEDAERVIIAMGSVTEAAREAIDYLTSQGEKVGLVAVHLYRPFSAKHFLAAVPKTAKTIAVLDRTKEPGANGEPLYLDVKDCFYGAENAPVIVGGRYGLGSKDTTPAQIIAVFKNLAMPMPKNHFTIGIVDDVTFTSLPQEAEIALGGEGMFEAKFYGLGADGTVGANKNSVKIIGDNTDKHCQAYFSYDSKKSGGFTCSHLRFGDDPIRSTYLVNTPNFVACHVQAYLHMYDVTRGLRKNGSFLLNTIWEGEELAKNLPNKVKKYFAQNNISVYYINATQIAQEIGLGNRTNTILQSAFFRITGVIPVDQAVEQMKKFIVKSYGKKGEDVVNKNYAAVDRGGEYKTLTVDPAWANLPDDAKVENNDPAFINEVVRPINAQDGDLLPVSAFKGIEDGTWYQGTSKYEKRGVAAFVPEWNAENCIQCNKCAYVCPHASIRPFVLDAEEQKGANFEMLKAVGKQFDGMTFRIQVDVLDCLGCGNCADICPGNPKKGGKALTMKHLESQLAQADNWTYCADNVKSKQHLVDIKANVKNSQFATPLFEFSGACSGCGETPYVKLISQLYGDREMVANATGCSSIYSGSVPSTPYTTNAKGHGPAWANSLFEDFCEFGLGMELANEKMRARIVKLFNEILAADNAPAEAKEVLKAWIENMYDADKTKELAPQIEAIIEQGIAAGCPISKELKGLTQYLVKRSQWIIGGDGASYDIGYGGLDHVIASGKDVNILVLDTEVYSNTGGQSSKATPVGAIAKFAASGKRVRKKDLGLMATTYGYVYVAQIAMGADQAQTLKAIREAEAYPGPSLIIAYAPCINHGLKAGMGKSQEEEEKAVKCGYWHLWRYNPALEAEGKNPFTLDSKEPNWDDFKGFLKGEVRYASVMKQYPAEAEELFQAAEDNAKWRYNNYKRLANQAWGAAE

SEQ ID NO: 10309 - protein, 281 aa, B.fragilis
QLSLRMLRPNRAYTLVANTGKQIRYGELFNRLSGYDVIFLGELHNCPITHWLEFEITRSIYNIHKDQLMLGAEMFESDNQLIFDEYMQQKISYDRFEAEARLWDNYRTDYYPVVFFAKEHHIPFIATNIPRRYANIVKNKGFEALDSLSEEAKRYIAPLPIDFEYDEAQSAAAFSMMNMMGGRRAGDNRKLAQAQAIKDATMGWFIARNIKNKFLHINGSYHSNRQGGIIPYLLRYRPNTSIVTVTSVRQESIRKRLHNGDGRFNSPRDSSSLVKTKTGTY

SEQ ID NO: 10310 - protein, 280 aa, B.fragilis
SSLRHRGSFQPRGEDSDTKNPAVAAAGTTLLFGVPNIISEQKQTQDLTGYRPRKAHTYDYAQTKGDELLGTNACVVFRSAEANLNYMEACYEKTGSLDAKAQKYWKALRTRAGVDDDYAKTIAATDLSKENDLAVYSGSKMVDVTLYNIRRERRCEFIGEGMRWDDLKRWRSWDQLLTKPYIIEGINFWDAAYKDHKDIKDDGTLDANVSPKSDSKYLRPLRRTSINNELYDGLTWRKAFYLDPIGIEDMSLTATNPEDINTTQLYQNPYWPMTAGKALE

SEQ ID NO: 10311 - protein, 617 aa, B.fragilis
SLSHYSGEGSLLKRNIEMKKQLRSSFSTQGRRMAGARALWAANGMKKEQLGKPIIAIVNSFTQFVPGHVHLHEIGQLVKKEIEKLGCFAAEFNTIAIDDGIAMGHDGMLYSLPSRDIIADSVEYMVNAHKADAMVCISNCDKITPGMLMAAMRLNIPTVFVSGGPMEAGELDGQHLDLIDAMIKSADESVSDEEVSKIENRACPTCGCCSGMFTANSMNCLNEAIGLALPGNGTIVATHANRTQLFKDAAKLIVENTYKYYRDGDESVLPRSIATREAFLNAMTLDIAMGGSTNTVLHLLAIAHEAEADFKMDDIDMLSRKSPCLCKVAPNTQKYHIQDVNRAGGIMGIMGQLAKSGLIDTSVVRIDGMTLGEAIDKYDITSPNVCEEAIKKYKSAAAGKFNLVLGSQDVYYKELDTDRAEGCIRDIEHAYSKDGGLAVLKGNIAQDGCVVKTAGVDESIWKFTGPAKVFDSQEAACNGILGGKVVSGDVVVITHEGPKGGPGMQEMLYPTSYIKSRHLGKECALITDGRFSGGTSGLSIGHISPEAAAGGNIGKIKDGDIIEINIPERTINVRLTDEELAARPMTPVTRERYVPKSLKAYASMVSSADKGAVRLID

SEQ ID NO: 10312 - protein, 569 aa, B.fragilis
YMSKDIISGGEALMRSLEYHGVKTIFGYPGGSIMPVFDALYDHRETLNHILVRHEQGAAHAAQGFARASGEVGVCLVTSGPGATNTITGIADAMIDSTPIVVIAGQVGTAFLGTDAFQEVDLVGITQPITKWSYQIRRAEDVPWAVARAFYIAKSGRPGPVVLDFAKNAQVEKAEYMPAKLDFIRSYVPVPETDPEAVKAAAELINGAERPLVLVGQGVELGNAQQELRAFIEKADMPAGCTLLGLSALPTEHPLNKGMLGMHGNLGPNMNTNKCDVLIAVGMRFDDRVTGNLATYAKQAKVIHFDIDPAEINKNVHADVAGLGNCKETLSAVTALLQPNEHKEWLDSFLPYEQVEEEKVIRPELHPMGDTLSMGEVVRAVSDATNHEAILVTDVGQNQMMSARYFKYSKDRSMITSGGLGTMGFGLPAAIGATFGRPDRTVCVFMGDGGLQMNIQELGTIMEQKAPVKIIVSNNNFLGNVRQWQAMFFNRKYSFTPMLNPDYIKIASAYDIPAKRVFTREELADAIDEMIATDGPFLLEACVIEKGNVLPMTPPGGSFNPMLVGMLIS

SEQ ID NO: 10313 - protein, 235 aa, B.fragilis
DGSRYVMAADGADGLVNGTVCGLKASLAVDVQGYAYRVVKIGSLYWMGENLKTTQFNDGTPIPTGFATSMDWGIQCGKGLPACQVDRAVNANAPGAMQYRNLYGVLYNQFAMKGNIAPQGWHVPSKAELQALVDFVGADARKLKSTAVGKGIGNWLEDTGIEANNLTGFTALPANTVNGGNGSTGAQETTGQWWSTETSYRIRMSYKSNSVELLTSGNALAGEGNSIRCVRDANY

SEQ ID NO: 10314 - protein, 80 aa, B.fragilis
  UNSURE (80): Identity of amino acid sequences at the above locations are unknown.
PNVGWNANKLGIMDKTLCLSHGAWKDPPLALSMAIACFWCENWYSVHNSHPIITNSENIKMYKPCGCPNGVNPTLTIICX

SEQ ID NO: 10315 - protein, 718 aa, B.fragilis
LLAMRWRVKVTAFVVSGMQIINLTLMNMNHIIKLLFLCLFFATACSQEEMNEVLKNHAEMEGQVNSIEELCKNMNRDIVALKLIINSSESGDYITGFKELADGSGYTISFFKSGTIVIKNGEKGDDGKKGEDGQDGQNGQNGTDGKDGQDGTDGKDGQDGIDGQDGQDGTDGKDGQDGTDGKDGQDGTDGKDGQDGTDGTDGPEGDKGQNGTAPVVTMKMDTDGHLYWAIKNADGTSSFLLDNNGQKVRASGTDGIVPVIGVNAAGYWTLDYGSGPVELKDAAGNPMKAKGASGDPMFRKVVSEDGYIVFYLTDGTIFKVPEWGGAQVELAASGVTYFHRSESLTFTFTCSGVNKSIAPVCTAPVGWTVTAQYTSDTTGEMTVIAPDKSSADGALSGTAILELTAKDGKKLSATLGVTLLLEFKVPDSSRSFVYELYVEGVKVGELCHEFIPDYSFGSGKSASVFYPYNVYNKAFGEGMVLDNGGKVDYLTTVYTPGTNTQPFTSLFTEDGVSFITGDYIGYSDSQANGLRPYLTTDNEGNSYRVMKIGTQYWMADNLRTITNSAGVISSEWRKDANPRYAVYGFPAGITEDSRTIRNQYGLLYNAGVFSGSTSLVTEGWKIPNHLGDWDKLRNFLGGDSKVAEALSIAGFVGKPGGRRNADEPFAFQEKDEVGYWWFSSVDGHNCWALSINPSNVSVPQSTNTYSRGYGFSIRFIRQ

SEQ ID NO: 10316 - protein, 397 aa, B.fragilis
LIIVNMKNIIGILGVFILAISCSGGKKESADAGLELTEDSVVYLLADNVTLGIKALFPFIDKDGHEYLTFQNQLEPEICVYDLQSGEFVKSIFFDREGANGVGMFGGYHIIDFDEIYLPSLQQSKVFVMEESGKKKREIITEKTDDGIPLLPFGAITFAYRPIYFNNRKMYIPQTINMRLGNKVMEKSPVYVVVDTVKNVLSPFPIKFPPIMSSDDVTKPSLGNELSYSCCLNDKDQFVFSFFFDEDIYVVSLQDGEMKKIKVKSRYIDKPAIKENPPQDFDGAMKASSEIPCYGNLIYDKYRKVYYRFVYLKTDLDGEKNYLNIWQYGRKSFSIMILNEDFDVIGETRFPDFTYISTLHYIGKDGLYLSDSHYKNPSFDENKLRFRRFKLVHYNKK

SEQ ID NO: 10317 - protein, 305 aa, B.fragilis
RYSKTLKTLLYILVFSLCYTNAYCQSIPREVTLDEVINRLSLESSSAKIELLNFQNDLLRYENYKKSFLPAFVLNFNPINFNRSLRLLQQPIDGSYSYVEDNSNNTNFGTTVRQKISITGGELSIGSNINYLNEFSRKQNSFSTNPFFISYSQQLWGGGKLQRLENKIERAKNEVAVKQYCSNIAQIQQQALTLYLSAILSKMDSELAIDIKQSNDTLLHIAEIKLRNGSITEYDYKQMELQSLNLQYMYENAVKHYAESIQKLFTFLGIENNAEITIPDFDLPLTIDARLHHGGGRISAHVSLT

SEQ ID NO: 10318 - protein, 83 aa, B.fragilis
PRSEGYVVYSVEQAEGSIMLDELTLDRSKKYAVVMGNEVKGVQQEVIDHSDGCIEIPQYGTKHSLNVSVTAGIVIWDLFKKLK

SEQ ID NO: 10319 - protein, 80 aa, B.fragilis
TDPLDPSSPVVKTLYKYRVFISDFKENKEKFQDNKFPNSINVSKRIKQTTYHSFFIYSHPVWVIYPKPLPLHPQNPNKSD

SEQ ID NO: 10320 - protein, 140 aa, B.fragilis
FRTDIKMTAQEFFKNDLFATNAGVELIEIREGYSKAKLEIKPEHLNAGQRTQGGAIFTLADLALAAAANSHGTLAFSLSSNITFLRASGPGDTLYAEARERYTGRSTGYYQIDVTDQEGRLIATFESSVFRKKDEVPFTL

SEQ ID NO: 10321 - protein, 304 aa, B.fragilis
AQSRTNLKNRNQMKTRRKRPEIVKTQTVAAAIRRKEWICLIIALLFAFPSSGNAQCEAKNDAFKSGEHVMYELYFNWKFIWKKVGLASLTTNSTTYHSEPAYRVNLLAISSKEADFFFKMRDTLTSVMTEKLEPRYFRKGAEEGKRYTVDEARFSFREGMCYVNQKRVRKDGSITETEQSDNRCIYDMLTILAQARSFDPKEYTIGQRIQFPMATGRRVEEQTLIYRGIKKITAENDTTYRCLIFSLVEYNKKGKEKEVITFYVTDDRNHLPVRLDMHLNFGSAKAFLKSVSGYRHPQTSIVTK

SEQ ID NO: 10322 - protein, 320 aa, B.fragilis
HKRIKAHQTDYVSFILYLLASCLGDIPKTTTFAPSKPKQKRLMKYKLLVLDLDGTLTNAKKEITPRNREALIRVQQQGVKLILASGRPTFGIAPLADELRMKEFGGFILSYNGGEIIDWSTGEIVYANVLPDEVIPRLYECATRNQLPILTYDRQYIITEYPDDVYVRKEAFLNKMQIYPSKDFLKDIRLPLPKCLIVGEPHRLIPIEAELSVELQGQLSVYRSEPFFLELVPQGIDKAQSLSVLLNKLNMNREEIVAVGDGYNDLSMIQFAGLGVAMGNAQEPVKKAADYITLSNEEDGVAAVVNKFFTKAPEKGETTA

SEQ ID NO: 10323 - protein, 495 aa, B.fragilis
ISNVMEHQLTIYNTLDRKKELFVPLHAPHVGMYVCGPTVYGDAHLGHARPAITFDVLFRYLTRLGYKVRYVRNITDVGHLEHDADEGEDKIAKKARLEQLEPMEVVQYYLNRYHKAMEALNVLPPSIEPHASGHIIEQIELVKKILDAGYAYESQGSVYFDVAKYNKDHHYGKLSGRNLDDVLNTTRELDGQEEKHNPADFALWKRAQPEHIMRWPSPWGDGFPGWHAECTAMGRKYLGEHFDIHGGGMDLIFPHHECEIAQSVASQGDDMVHYWMHNNMITINGTKMGKSLGNFITLDEFFSGSHKLLTQAYSPMTIRLFILQAHYRSPVDFSNEALQAAEKGLSRLMEAVDSLEKITPAATSNVDVKSLRTKCFEAMNDDLNTPIVISHLFDGAKMINNIIAGNNTISADDLKDLKEVFHTFCFDILGLKEEIGSSDGREAAYGKVVDMLLEQRVKAKANKDWATSDLIRNELTALGFEIKDTKDGFEWKLNK

SEQ ID NO: 10324 - protein, 214 aa, B.fragilis; identical to SEQ ID NO: 7265

SEQ ID NO: 10325 - protein, 62 aa, B.fragilis
NYPPHIRKAIKAFLYYLKIPKNTIFFLPKKLSITYSFFTFKNLYLIENHLKIFYYLKSLSNT

SEQ ID NO: 10326 - protein, 73 aa, B.fragilis
RHSLPTGIIATKYSDGFFLPSRKTNLISIALIATALLCYDWSLSLKWWSLLYILMFIICLAIPDYLVRQKTKK

SEQ ID NO: 10327 - protein, 453 aa, B.fragilis
ITVPSRGQEGRLLTHYSKTSMNKRCLLTILLGGCAAMGAFAQQHATGKKTEMSVDLNPVVVTGTGTHQRLKNTPAPVEVVTANEIKKAGITDFQQAMTMLVPSLSFSTNSMGSYLMMNGLSNKYVLILINGRKLTGDTANNIDLSRIDMSRVKRIEVLDGAGSSLYGSDAIAGVINIITNEPKELMQVTSTTRYEDHRQLTQMVNADIATEKFGSYTSYKHEQSAGWQNSDLAYVTDKKGNVSTVPTVSATSNGFHSNLVNQKFTFEPTEKLSFYANGGYYWKLTDRPVYTADIDGGSKYDLHYESYNFGLGGRYKINKRSSIQLDLMNDNYMQNYKYTVADDKNKIAIGDYAKTKEQHFYDAELKGIFNFAKNNMTVLGVDYRSESLDRPSARVDKSVYTASAYAQHEIKLWNCLTGIAGVRYDYHELAGGRFTPKLAVVFTTGVDRTGLHL

SEQ ID NO: 10328 - protein, 77 aa, B.fragilis
PVKHDGKVAFQKGIVRKPAEADIDNSALPGSGRPFTNTLFKNINEQKMLTDHPLGRMRGNGCICTTTRDRQEDRDEC

SEQ ID NO: 10329 - protein, 210 aa, B.fragilis
SKETINVKLNFKREFMKRKLMLLLTCLFMGIGLVTAQTQKVTGVVISEEDGQPVVGASVLAKGTTVGVITDVDGKFTLSGIPSSAKTLQISYIGMQTAEVAIAPVIKVILKTDAKALDEVVVTAMGISKEKKALGYAVQDVKGDKLTQASSSNLSSALQGKVSGVEISPSSGMPGASSKMTIRGSRSFTGDNTPLYVVVFTKGVHPTVFI

SEQ ID NO: 10330 - protein, 68 aa, B.fragilis
CRCYQSHALQVYAEIEKKELGLVQPGKQNSLDLFKDSFENKTKALNLLIFSHEIPKTSLKESPKRNFF

SEQ ID NO: 10331 - protein, 614 aa, B.fragilis
  UNSURE (570),(587): Identity of amino acid sequences at the above locations are unknown.
KQTLSDTSSPVVRNCSMSSTINGCGVWMCSDHTIFIGGTGGLSSFLEKDLNKEYPKPKLYFSSLSVNNARISPDDKSRILTEGLPFVREINLNATQNNLTVEFASSNYVDILNNTWYEYQLEGFDKQWSLTSQTSLKYTNLDPGDYVLHVRQKGNSLKMRKAQEILLQIHINTPWYLTWWAWLSYITISISVTYFIWREKSSRRTLAMSLEKERIEKEHIEEMNQAKLRFFTNVSHEFRTPLTLIISQVELMLQKNTIPPSLHNSIFRIRKHAQQMKLLISELLDFRKFDQNYIQLKLSEQSLNTFLEEVYLSFSAYASQKSISYHLKLLEQDISIWIDDWQMRKVLFNLLSNAFKHVPDKGEISILTSTTPDQVVIAVKDSGNGISKEEQERIFDRFYQADNRNKAIHVGTGIGLALTKSIIQLHHGTIEVESELNEGSCFIVKLPKTRDCFEKDTEVVFLESPEKEPMVQENTIPDENFMKKDDSTFETPLIDEREGKRKVLLVEDNVELLQVLKEIFSSLYQVVTAANGEEGLKQAFAEVPDLIVSDVMMPVMTGTEMCLKIKNNIXLCHIPVVLLTALDTVDXNIEGLPRGADDYITQPFNAKNLITPCK

SEQ ID NO: 10332 - protein, 145 aa, B.fragilis
EDSTISVGIERGKVYTFDLRYVPAPERFSFVIDKKDTQRVAILDEKERSYGQKERIREAIAKRTPLDLGLKDKNSGVEFEVGNIFIDGDILLLRMTLINRTQIGYTTDFMRFYIQDAKIRKKTAVQQLEQNILFTFDYTGRSTGT

SEQ ID NO: 10333 - protein, 60 aa, B.fragilis
METAFAGYGMDPDAKAAALPEPVFQGTGERDLVGYSVPGEYIPVVFQCLQAFAPVQCLVE

SEQ ID NO: 10334 - protein, 193 aa, B.fragilis
SRQNIKEDSPMKLLLPLLLFCLPFNGSNGGKELLDKALDRCERLETLENYRDILSRYGVSDKIPLACPLKDRFRKSSGFGIRIHPITGKRSFHSGIDMAVGLAAPVYATASGTVSFAGRKGGYGRCVIIRHSYGFETLYAHLAAYYTTEGQKVDKGAVIAFAGSTGKSTGYHLHYEIRKNGKPIKPYWYGYDD

SEQ ID NO: 10335 - protein, 117 aa, B.fragilis
TAHRSVIRRISCGSTSRMPRSAKRRRYSSSSRTSCSLSIIPEEVPAHESRTFTVAMNKFTIPDKKRLIIEIQERNGGRHFLYKLKNKSLLTAEEVFRSRKQQETEDEADKILRRIAR

SEQ ID NO: 10336 - protein, 117 aa, B.fragilis
NHTGMAMTIEQEIEQLVLQCIASDGLKACPKDLAFLEKYGLKNLYFFSLEYAMEGTDTTVLDSKAKGLIRWYLYSTDFPLLRQKYEREGKAELMKCLYLEERYFRKFLESTGQEEGL

SEQ ID NO: 10337 - protein, 64 aa, B.fragilis
VVAAAPSSPVVKTMSDSLVERKGASDEQHRKLLYKRYGRLTFREGKIIFLNSRCPAFYVKKEEK

SEQ ID NO: 10338 - protein, 515 aa, B.fragilis
TSKYCTSMDSILFWLVPFASVLALCFALYFHKQMMKESEGTPQMIKIAAAVRRGAMSYLKQQYKIVGWVFLGLVILFSVMAYGFQVQNAWVPIAFLTGGFFSGLSGFLGMKTATYASARTANAARTSLNAGLRIAFRSGAVMGLVVVGLGLLDISFWYLLLNWAIPADVLTPTHKLCIITTTMLTFGMGASTQALFARVGGGIYTKAADVGADLVGKVEAGIPEDDPRNPATIADNVGDNVGDVAGMGADLYESYCGSILATAALGAAAFIHTGDTVMQFKAVIAPMLIAAIGIILSIIGIFSVRTKENATMKDLLGSLAWGTNLSSALIVAATFFILWLLQLDNWMWISCAVVVGLVVGIVIGRSTEYYTSQSYRPTQKLSESGKTGPATVIISGIGLGMLSTAIPVVAVVIGIIASYLLASGFDFNNVGMGLYGIGIAAVGMLSTLGITLATDAYGPIADNAGGNAEMSSLGKEVRKRTDALDSLGNTTAATGKGFAIGSAALTELALLASYI

SEQ ID NO: 10339 - protein, 299 aa, B.fragilis
FPLSQPLRAKLKDYSMFDKKFNFYIANDLGRNGYYDQKPIAELMGTMGEEIGPEFVLAAGDIHHFEGVRSVNDPLWMTNFELIYSHPELMIDWYPVLGNHEYRGNTQAVLDYSGVSRRWTMPARYYTKTFGEKGATVRIVWIDTAPLIDKYRNESATYPDACHQDMNGQLAWLDSVLTVAKEDWVIVAGHHPIYAETPKDQSERSDLQSRLDPILRKHKVDMYICGHIHNFQHIRVPGSDIDYIVNSAGSLARKVKPIEGTQFCNPEPGFSVCSIDKQELNLRMIDKKGNILYTVTRKK

SEQ ID NO: 10340 - protein, 163 aa, B.fragilis
GLVLTSADPYRPAVKTTRIKTPKNEVVTIPNSFIMSSHTVNYSASAREYGLIIHSEVTIGYDVPWRQVHQLLIEAALNTPGVIDDPRPFVLETSLSDWYPVYQINAYIREADKLAQIYSDLHQNIQDRFNEAGIEIMSPHYMAMRDGNESTIPKDDLRPKTDK

SEQ ID NO: 10341 - protein, 333 aa, B.fragilis
  UNSURE (270),(304),(309): Identity of amino acid sequences at the above locations are unknown.
FIILLPIKYEKSLFSSLYITLSHIASVRGKSVAYLINKLFSNYFPEALQAQHSYFKLIPTSSEGGDRPRPDHSLKKQQILNIMKSFKIMLITVLSVMTLSCSEKTTTEIPETELKNISCSTQLVTHSSAQTRGAAPTTLNENDFVLYAFKKNGEGNFSYEEAKHETSVIDGGVWKYNAAFPVGTYKFIAFYNLDEKNQAALNTTITGISNQTWENILKSIVITHFPSATDQYHEDMNEIFCGKTKDAIDISSGVGGDDNEIKIKLTLERXVSRIDIKFIKVASDDDHIEVPYATGNNFGGTSTXSWTSXIFTSANVPLKYNPNGENPDYVTGV

SEQ ID NO: 10342 - protein, 300 aa, B.fragilis
LNSKIVMAKEILFNIEARDQLKKGVDALANAVKVTLGPKGRNVIIEKKFGAPHITKDGVTVAKEIELTDAYQNTGAQLVKEVASKTGDDAGDGTTTATVLAQAIIAEGLKNVTAGASPMDIKRGIDKAVAKVVDSIKHQAEKVGDNYDKIEQVATVSANNDPVIGKLIADAMRKVSKDGVITIEEAKGTDTTIGVVEGMQFDRGYLSAYFVTNTEKMECEMEKPYILIYDKKISNLKDFLPILEPAVQSGRPLLGIAEDVDSETVATLVGNRLRSQLKNCAVKARGFGDRRKKMVEKFPF

SEQ ID NO: 10343 - protein, 93 aa, B.fragilis; identical to SEQ ID NO: 7513

SEQ ID NO: 10344 - protein, 123 aa, B.fragilis
STCSPCWAFTVDGSRACSLNVEAVPTEGTYDFTGGTLSVNEGSGTVSSKENMLLLLPGRLEERRAQIRYLDRTYDWYLPANTFEAGKRYDYALTLSKEGVLILSGVSARPWETGGDYTGTIQP

SEQ ID NO: 10345 - protein, 227 aa, B.fragilis
SGITSGSSERELRSRYNSRLLPGERKNLPCRKRRKRKYGPGSAKPWIVCPGHRPAGDSTRSGSSGRKRGMSSRHSCTPHRPVWSGSTLKMQLAENCLTDDGQRIRKGTPVFGEVTGIDGERVLVKITSVNLGGNILPFEKQVYSEDAIQGIYVPGNVKAETAQEAGAAGISGANTNISGGFDMGSQLVAGAANSVINATKSAASKNIRKVKVTIKTNYRILLRQPKE

SEQ ID NO: 10346 - protein, 60 aa, B.fragilis; identical to SEQ ID NO: 10333

SEQ ID NO: 10347 - protein, 327 aa, B.fragilis
LIIYFFQMKMKTSFFLSAVMAAGLLASCSNSEEVFNEQVTDGEHSGAQLNIVPTVSSESTETRASFDPKTDWAAGDGAGLFMYKVHGWGDAYPRYDAQNNKSTRQANGWSQASPVYLLVDKATIWAYYPYNQAVTDGTKIPVPINVGTSVDYMWGKSTNQVSVIETDARIPMKHALSQFVVRLKVSPEYHNDGNLTSAKLKATASKFATTGTMNLNDGGKITFQPTSTELTWSPNTTVPAQGQQAVDYAAAIYPMTLAAGEVSLEVVIDGATYTYAIPQITWEAGKRYIYSITMRSNDAEIGGKNGQSVTIEGWTSTEEDITLVPVK

SEQ ID NO: 10348 - protein, 224 aa, B.fragilis
TNGYKLYNETFMKATKSILNIQSILKDFSGLAEARKSYTLRTRLVFIFCGITIAMVLFFAHSVVNNAMNKILVVNEGGEFVHFKSMQQDLLYESLLKSHCRRTAYFLNSFDRLSLQENRARALFLVNKPDANTVFAKYQADRAYGDALELGVVYKTEFEKIIDIRADGEEYHVRFSSILSIINGDETRKVRILSEGTAIHATPRFPENTSGFFFRTYDQQYELL

SEQ ID NO: 10349 - protein, 397 aa, B.fragilis
TAFNNINIEVKFNMKPNKIYITTLLLLFFLSGRAQKIEELTAVPLQIGYEKTLHLIFPTEVKYYSIGGDYVIGEKVVNCPGIIRLKAAEENFPGETTLSVVTADTKFYSYSISYNAHPAQSYVRIGGEAPTPHTLPVGKEKQLFLIFPAGITYVDYGSTNVEVDKAEGVDNILAVKAVQPYKEDTNISVVLEGGKFYTFDLRYVPAPERFSFVIDKEDTQRVAILDEKERSYGQKERIREAVAKRAPLDLGLRDKNSGMEFEVGNIFIDGDVLLLRMTLTNRTQIGYTTDFMRFYIQDAKIRKKTAVQQLEQNILFTFDYPEEIPAHESRTFTVAMNKFTIPDKKRLIIEIQERNGGRHFLYKLKNKSLLTAEEVFRSRKQQETEDEADKILRRIAR

SEQ ID NO: 10350 - protein, 75 aa, B.fragilis
TTTKNKNYNRMETIWEKVDYLGRILCCIIMGIAYILIMIAPLYASRHEQSGQRSDEKASVDGEEKVPDNGPEPEK

SEQ ID NO: 10351 - protein, 810 aa, B.fragilis
RRNKMKEEEAYSILDIISESDGQSVILTRSGSICIPFELRQPECYSLSPEDIDERDGMYREAFRHMPDGAYVHKQDVFLKKEYHPGKGTGSFLDRADARHFEGRLYIDHTCILHFVLAGLKSLEKAYVSSPLAYKEHLHREDYRKLEAFLEGVDNAVSILQNMRGNSVLPMSCEGISGFTRAYSGLFGDTDAVVDIHVDGSLHVGKNHARCYAVCDETFLPEGNIESYVRDESLPPAASQLYHPLMEQLGMYLPYNHIVNQVIYFEGNERLRSRIARNIDIYGSNSSMNKGIEREFKELEKLQTEILEENQMLVRSFFSVCVFDGSDTELEKADKRIREILNLNRFKYYIPGYGNLARMHFACVPGQISLMPVEYLFLTTLPIALCFFLQCGKFSNDAEGIYVHDRMYQVPLRKDIWDAAKKRVNARNGMVIAGTGGGKSAFTLNFTQQLIEQDYTTIVVEFGNSFSQLCKLYPDISLHVDYDGKTPLGINPFDLQGGEPDNNDLETLSGIVQRYWKHMFTKDESEKEVALTRFIQDYYEHVRQGHNFESFYNYVIDNYDEILERKHIPGTYFTIESFKLNCGEFMPGQRYENVCKDMKIDFSGKKFIVFELTRIKQDRFLSNLVMSMIFTVIQKKLLSDRRKRGILIFDEYAETAQMVDTATGSGIHSSVAFCYQKIRKENGAVYTIVQTPDQLPDDENTKNIISNTDMLFVLPTKEVIYRTIIDKFKLTQPGQIALMKSMRNNFAGSRPYSECFMRMGENYATVTRLEFSREKFLAFQTEGEILSDLEDKTGSGKSMQEAIEEYINEH

SEQ ID NO: 10352 - protein, 193 aa, B.fragilis
  UNSURE (161): Identity of amino acid sequences at the above locations are unknown.
SRQNIKEDSPMKLLLPLLLFCLPFNGSNGGKELLDKALDRCERLETLENYRDILSRYGVSDKIPLACPLKDRFRKSSGFGIRIHPITGKRSFHSGIDMAVGLAAPVYATASGTVSFAGRKGGYGRCVIIRHSYGFETLYAHLAAYYTTEGQKVDKGAVIAXAGSTGKSTGYHLHYEIRKNGKPIKPYWYGYDD

SEQ ID NO: 10353 - protein, 204 aa, B.fragilis
QKMKIKVYKHIAMFLLPAALTGCSGKEDSLPGTGEAGLEIENCFSRSTGTDTGHVPVKDFGMVLLDETGGSYTGVSNPLHVTYGESWNFPQVTLTQKTCRLFAFSPFRSIPGKEVAVSLSPQTDYLASDEVRLDWQNPQASIEMKHLLSLLGIYRRREPGMQPECGSRTDRGHIRLYRRYIVRKRGKRHRFFQGEHAAAPARQA

SEQ ID NO: 10354 - protein, 73 aa, B.fragilis
ASRFIEQHHAEVLYRNMARIRTGTAAETVFYLKSRLSCPGEGIFLAGTARKGRRQKKHGYVFIHFYFHFLLFV

SEQ ID NO: 10355 - protein, 140 aa, B.fragilis
LRVDPEQGRGAHTLRCECPSLGNGRRLYRNHTTLKTTIMKRKFLLSAFLFASTLRGYAQDARGAMNQILDGYTLPIFAACMLVGLALGVVQQLDNIIDKENRGTRRDGLFALGWYVGFSLLAGVVITAAKAAISGIKLTI

SEQ ID NO: 10356 - protein, 62 aa, B.fragilis
NRCDMETIQEIIDMIKELSGRDILFLSFYCGFILILSIHRSDEKASVDEEEKVPDNGPEPEK

SEQ ID NO: 10357 - protein, 434 aa, B.fragilis
KRCDMETIQEIIDTIKQWPSTIWWVMGALFIISWFWDTPLRKKRNKDKVTDDKNNNLKSSNMTDKKELRGNLMKEGVILWTVFTGEGKAALRMDNEIHAENGKIGHGRLLSPDVPVLHEILTPDNAYSFLSLSEIGVWIRIRMRLRYPGIEDSAVKQSEYEPEMCFPAWIAGEKTGRISLFLQEPSTGICAIPDMVGIPGLPDLQPDSVPVKVEMLIRKASPLLEHPEYSEDIKKRADRKSNLMKEGVLVWIMFTAGEKAVLYANDRIHFTEDGKYVPGKLLSSDISPFHQIYDWDVQYPWIRSKPEISVRYRIRLRYPGANDAGIEQSEYEPEACFPAWIVPQEGGQTGLCLEEPSTGQYFIPDMTGLPGLPELQPDGIPLRVELLIRQAHWISDVADPAYLKIISYSASLKAFSTKISDNQEVKSCNIQTEI

SEQ ID NO: 10358 - protein, 154 aa, B.fragilis
ALLDVPEPPVKTVQRLNIQINVSGNTAPLAGLKGTLTGISTGRYLVSRERTGNASVTSLFARKPETDRWKTSLYAFGFNPAAENILSVKIEMDGKDSVFNEEQKVDLTPYLRGFDSDELSLELDLHIGKELTIGEPVVIPDWEDIPETELPNYN

SEQ ID NO: 10359 - protein, 283 aa, B.fragilis
GGKENSQDLPGNKPVRTAQKGIEVRGMEEAYGNLNAAYLQIKGMVVIEGFYALIAGFVITTFVFKLVGIIKEMTNEGKGFNARHFYELGREYIFCIGLICIMPVLLGALETVLAYGADELMKSLASGGVYNPHNIWKDPISAMLDELMNGDITDIAVNGIDTLKWSLISGTVGSLFGVAYDYIMLLFLCTRYLILLLLEIISPIAIACLYNKDTRSSFYTWVKQMLGCYMLYPGFILASVFSDLIVTNYVLQRSWSVLLMVIFSFLLKLTMLGTVKATVNKWL

SEQ ID NO: 10360 - protein, 548 aa, B.fragilis
PAGEPSGSPIKKRIMVRAITTIVCSLLLLLAFSCSREDTGPQETIPGSGIVTFTAMTGQGETRSSQEGSFETGDAIGVFAIEPKTGVYWAVNNKYTYDGQKFKPEAEADNIIVTVGTDFDFYVYYPFKAGQTDITGISHTAGNQSDKSGWLSADFMTATYTDPIRNYTVPLHFKHRMSTVEVRIDRNDGVREATMENVKRTSRFNLLTGGITTDESRGSCTMHKYSETGGTTVFRVTIPAQRLTTSSNYVALTGTTPIKLRGTSDMVTEEGKIHNYRMDYKKQVTILDYAPGGTTTGAGLYNTGSNCTVSASVKPGYEFAGWYEGGRIVSGTAQYSFEVLADRTLEPKYRNYGSWRVTLTANPSAISWKGGTSTLSAGASREVFVNGVKETLQGGSPSISGGTEGFFLSGNTVSVSENNTASARSCVFTASHGGSSATATISQEAPPVSYVFEYSDGTVAHSERAEAGAGSFLLSITSRKTIGNSIKELSWSASGDSWIHVSGSSVSYDENPTKEIRSGSVTLTQAESGKTLTLTVRQKGKTSIDINP

SEQ ID NO: 10361 - protein, 148 aa, B.fragilis
GYIRLLQAFQPCKYKVQDTGVVDVQASFKVARVGTVQERAGAFARVVLFFKEYILFVYVGTVGHVPEGFPVHPVPFVDVFRGKGIALRLPELERDTYAAAPGQDHALSIGLADNVKYAVCLFLFHLVSSSEVVCLWLSYSRSCRTSIP

SEQ ID NO: 10362 - protein, 204 aa, B.fragilis
PTIRALMTRDGKSRIAILAGLGIVVVLLVWAFIASLPASGSKEPETGEVILRTRIKDSFTLDDMLQKVGKENTSKSASLSGFDPVTEEPADTAGNEREIRRIQELIRDNERELGAGITVPVQQPVASRGKEKPALQEKKEEEVRPGQRKAMDSVPRAPTRRGFNTVRLVRQEERNVIKAFVHSTQTGMVGFHPQDAAGRELPDR

SEQ ID NO: 10363 - protein, 177 aa, B.fragilis
NKKRMKKLCLSLIVMMTADTVSAQWAVTDAGNLSQNLKNLKELHRQVGYLKEQKSLLDESLDMMRKVNSVVSDCETTRYIIERQARLSEKCVDLLSGKQLNPSTLQTLIGSIEQIMAGNRRLIQLSRTILSTSVRMNDAERLSTLQNIERQTLEEERKIARISQVISQYEQLKRALR

SEQ ID NO: 10364 - protein, 151 aa, B.fragilis
AFTIINIMPTNYNQLLKDLEIGSVYIKIFICFLGCTFMLYPVLFYFTHFFRELSVYEQIFFALGSSALYTGLGVPLSITSAIRYPGVFYLPLMLLSVSVIATIYIVFFMARSYDPLTTLLWILPTSYLLNLITGVISILREKKYPKTEMYY

SEQ ID NO: 10365 - protein, 217 aa, B.fragilis
ELVLLVIGTEEETGRIFRKARGGMDGGTLTQDPHFPGLIAVDDAQDGGEPDMVLLTVGAYVDDLFKLRLVDNSEFQRIAIGTVRLVFGKYGICVRLIDQEQGTGTVFLKGKPVEAVQEIGRPAAVAFQEAFVQQVLLHGLEMDEFPAFVDHQYLVHRIVHHAVREEQDHRDGYPAENEYQPGAQRIALPGFGQAGEILEYALYIEYAFGCFHESFII

SEQ ID NO: 10366 - protein, 204 aa, B.fragilis
NFHKRRPNQSNFFKKERDPRILYLQVRQQGQPQAKERFRDLFVIGCLTALRYSDYSTLTQDNLQGCFIVKRTRKTNVDVKVPAHDYVKEIFEKYDGDIPTGLCIQHFNKYLKVIMREIGLTDKVSYSFTQGGKLHTVTKEKWELISSHTARRSAATNMYLTGRMKTLEIMKLTRHRSEHNFFRYIRLTGDDTARSISGDMFFRK

SEQ ID NO: 10367 - protein, 71 aa, B.fragilis
RILKIITMKKFIEVSTENGKFLVNVNTISCLYTIKDGRTRITLTAPSSKGDIFINAQESYEEVKALIKAAL

SEQ ID NO: 10368 - protein, 79 aa, B.fragilis
DMNIDTEFNVGDSVCYLSGDNICHSTISKITIEISYTDRSFSMVYKLSDGLSVPRNNYPQWDKKLFRDKDDLIRYLSES

SEQ ID NO: 10369 - protein, 150 aa, B.fragilis
LKRILEKSMKSTEILKRIQIQHLLTSSAVDSLARTSALLEKVSELSVKEAAYGLKCIELYGKLDLNTSSLKTAQCSLFGDLNESYATFPKSGMMQNGNVYQAPTLVYNRVGNGYIVLPTPVKSTANGACKNRYFGSPTSSPRGWKDSACV

SEQ ID NO: 10370 - protein, 72 aa, B.fragilis
YRQIHKRRYVFQKINLLNFKITIMIKKIIRYLRKRKDMKLRKWCITLAANELSRGEAIDAANEIYKWVKEQP

SEQ ID NO: 10371 - protein, 205 aa, B.fragilis
SYKIFIRIITNLEMKQSELTHGSLFSGIEGFGLGAAFSGIRTLWSCEYEDYQTSIIKKNFGEEHEINRDIKTYSNPTFVDIISGGFPCQDISVAGKGVGIVGERSGLWTEMYRVIREVRPKYIIIENSPMLLIRGFERVLCNLSEIGYDAEWQCLSGTDFGIQQGRERLYCLAYSCEINSKRSMQESIFRKPYVFTTGLEGQRVR

SEQ ID NO: 10372 - protein, 276 aa, B.fragilis
YISLWRHRPCRRSNFSIPDRVKYDKDCFTIEGKDIFILSAAFHYFRCPQELWRDRFRKIKEAGFNTVETYVPWNWHERNMPKSVDDYSQCNFDDLKAWLHMAHEEFGLYTIVRPGPFICAEWAGGAYPRWLAKFCPDSYDTSFWLRSNHPEHMKWSEHWYNAVCRVFSEEQLTRKQPGEKGIIMVQLENEYIYFDMESEKKEEFLRVLSDACIRNGIDVPLFTCVTPEVRGSHHPVISQLFDMNNQYVWWNMHEAKSRIEKLENRVFTSRWSTTGV

SEQ ID NO: 10373 - protein, 217 aa, B.fragilis
EKFVLGCIKRIWGYPHILENGILYLLIRKTCRAGKNHISVTADGLRGGTRGIVTRRYDGVFVPEGYLVPYSGDEEEGVVVKATAWENVICTKTPLKVVRVEATSEQKRYEASHITDGDDFSWWIADDESQPQIVLLELERSVNVFASRIRFQKDSSTYTHKVEISIDGKNWETLYERECTGWDFKPVQIGKELKYMRLTIEKSSEGAAGLAEVTLYQ

SEQ ID NO: 10374 - protein, 362 aa, B.fragilis
NPKPMKLKHIPLLLLVLTCCPACQNKKASATKEIPSEATYTNPLLAVGAEPWAVFHEGKYYYTQGAENKIILWETNDITDLEHAARKEVWIPKEISNSYHLWGPEIHRIDGKWYVYFAADDGNMDNHHIYVIENSSPNPLEGEFVMKGRIKTDKDDNWAIHASTFEHQGQRYLIWCGWPKRRIETETQCIYIARMENPWTLSSDRVMIAEPEYEWERQWISPDGSKTAYPIHVNESPQFFESKNKDKVLIYYCASGSWTPYYCIGLLTADAGSDLTNAASWKKQDTPVFEQQPEDSVFGPGSPSFVPTPDEKEWYMLYHARKIPNDAPGATDSRSPRLQKISWDANGMPVLGKPCKEGTQIK

SEQ ID NO: 10375 - protein, 205 aa, B.fragilis
KDYYGHGTEARKPGTAIARTLFGELNPSGKLPVTFEKRWEDNPTFHSYYDPDGDKHVEYTEGIFVGYRGYDKLKREVQYPFGYGLSYTRFKLSAPTVGTPKTDGSVTVTCKLTNTGRTAGAEVVQLYVSNKDTTVEHPEKELKGFRKVYLEPGETKSIEITVPAEAFSHYDTGSRRLVIDRGSHDILLGFSSRDIKAKMSVGISR

SEQ ID NO: 10376 - protein, 292 aa, B.fragilis
LPMNALHPWRSTEEILKKQEQVNRKKKELQQVKVAKENLLREREGEKAKLEAQEKEKREIVAGLQKKQKGLQSEISKKRREANQLNAKIDKLIAEEIERARKRAEEEARREAAARRKAAAKESKSSSTGGGTVPAKKKAEPLERFTMSKADRELSGNFVSNRGKLPMPITGPYIITSHYGQYAVEGLRNVKLDNKGIDIQGKPGAQARAIFDGKVAAVFQLNGLFNVLIRHGDYISVYCNLSSASVKSGDTVTTRQAIGPIFSDGSDNGRTVLHFQLRRERDKLNPEPWLNR

SEQ ID NO: 10377 - protein, 1050 aa, B.fragilis
IQHMRIITLLITLFAFGITPLQAFSYFSFKKYQVEDGLSHNTVWCAMQDSYGFIWLGTSDGLNCYNGRGNKVYRNVLNDKFSLENNFVQALFEEENHNIWVGTNWGLYIYDREYDRFTYFDKKTRYGVFISSEIKKIIKSESGLIWIATLGQGLFVYNPQTDVLTQNSLQTSFVWDVCENNSGHIYASSLQEGLLCFDENGKFLQSYPLLSAGNNPDNYRINCLLDIRSDIWFGAGSNLLYCLNERTGNLDCYNASHLNFGAIRCLLNYSETELLVGTDNGLYLFDLHDKNFSRIDNPSDPRSLSDQSINAMMRDAEGGIWVLTNLGGVNYLAKPTKRFDYYPPVYRDGGVAAGKVVGPFCENAAGDIWVGTRDGLCFFDVSTHQLTAYPIGGGVDKKYDIRSLLLDGERLWIGTYAEGLKVLDLRTGHVKSYNHLQDTPNTICSDDVLAVYKDRSGDIFVGTSWGLCRYNPREDNFSTITTVGSMVSVVDILEDMYDNLWIGTSNSGVFRFNTRNGHWKHFQHERNDSTTITNNSVITLFEDLKGTMWVGTNGGGLCSFDPKTETFIDFDPDNTILPNRVIYSIEQDKTGDFWISSNAGLITINPITKQHFRQFTVNDGLQGNQFTAQSSLKTASGKLYFGGISGFNSFVPDQFMDNQYIPSVYITEIRLPYTTDERLVQDILHLEGPLYRAETITLPYEHNTFSVSFVALSYEDPLKNRYSYRLKGVDKEWVINSEQNTASYTNLPPGKYEFEVRGSNNDHKWNDQTTSLLIVVTPPWWLTTWAYCVYTLLLLGLAYYAGWHWNRHVKKKYKRRMEEYQTTKEKEVYKSKISFFINLVHEIRTPLSLIRLPLEKLLEDKREGRDAKYLSVIDRNVNYLLGITNQLLDFQKMENGGVQLSLKKCDINQLVSDVHSQFTSPAELKGISVMLDLPEGEIFASVDREKVCKIIVNLIGNAVKYAQSRIDIKLVSSDEGFRVSVSDDGPGIPDVEKRKVFEAFYQVKDGKSGAVGTGIGLAFSKSLAEAHHGTLSLEDSVYGGSLFCSHFALG

SEQ ID NO: 10378 - protein, 301 aa, B.fragilis
ALKIVYMVDRSFVLTLPWGEEAVSEEPEVVIPDGREAADEEQGTELSGSKFTILLVEDNVDLLNLTRESLSTWFKVLKAQNGRQALEVLANETVDVIVSDVMMPEMNGLELTAKVKSDIEYSHIPVILLTAKTTLEAKVEGFECGADVYIEKPFSIRQLRKQIENLLKLRQAFHKMMSELSGGNGAAPISPVEYSVSQKDCELMAKVRAAVEAQLSDENFSVDTLAESLNMSRSNFYRKIKALAGMPPNDYLKTIRLNKAAELLKSGVRITEVCEKIGFSSSSYFAKCFKIQFGVLPKDYH

SEQ ID NO: 10379 - protein, 649 aa, B.fragilis
RNPVKTLTLQCLFSTAQKRFTADVEQQAEKILSQMTLDEKLSYIGGINWMYTRPLERFGIPRLKMSDGPQGLGTHGPSTAYPCALMLAATWNEQLATEYGSALGKDCRARGVHVVLGPAVNIYRAPMCGRNFEYMGEDPYLTSRMATGYIKGVQGQGVMATIKHFIANNSDYDRDHISSDIDERTLNEIYFPSFRAAVQEAEVGAVMSSYNLLNGIYTTEHPWLLKDVLRQQWGFKGILMSDWGSTHHCIPAVKGGLDLEMPAGSKMQPEELKYYLRTGDITIEMIDEKVRHILQTLLAFGFRETQQPDTHIPLNNPQCAQTALNVASEGLVLLKNTNQILPIRSGKVKTIAVVGKNAQGYVCGGGSGEVHPFQYVSVLDGIRKEAAERGIRVEYLDVYNYLPTIIFTDTERKQKGFRAQYFDNMNLEGTPKVEQTETKINYSWSGGTGLKEMPKEQFSVRWNGTICPQETDEYLFTLGGDDGYRLYIDGKLIADEWHEGAFRNSTYRCMLEAGKKYDLKIEYFQKGGGAAVNFIWKQKNASNNLFVEALNRNDLVVACIGFNSDTEGEGRDRTFELPEDEAQLLQNTLQSKRPVVGIVNAGGNVEMQSWEPSLKGLLWAWYGGQEARNGNRTYTLRGAQSFGEITCHF

SEQ ID NO: 10380 - protein, 216 aa, B.fragilis
FCPSELDIRKIYYLCPLKMRVRFPVLNPFVMKVKRFVLCLFMLTLIGGICFISCGNTSKAKAESDVAAETAEETFQSFLKKFTSSASFQYTRVKFPLKTPITLMTDDGNSEKTFPFTQEKWPLLDAETLKEERITQEEGGIYVSKFTVNEPTHKEFEAGYEESEVDLRVIFDLIDGKWYVTDCYTGWYGYDLPIDDLNETVKQVKEENDTFKELHP

SEQ ID NO: 10381 - protein, 183 aa, B.fragilis
AITSITLMEKIGIFCSASGSIDPIYFDAAHQIGEWMGKNGKTLIYGGANLGLMECVAKAVKENGGHVIGVVPSKLEENGKVSTYPDEIIATHDLSDRKDIILQQSDVLVALPGGIGTLDEVFHVMAAASIGYHQKKVIFYNADGFYNPLLAVLSELQTRGFTRHPLSSYYEVANTFNELTIKI

SEQ ID NO: 10382 - protein, 194 aa, B.fragilis
RLLSSGLFSLSLLENIEFMMTLIRITSADDSRLNRLIPLYEESFPESERRKIGQLKRMIENHAPMYFNAIECDGELSGMFVYWDMGDFYYLEHLAVFPEMRNKKIGQQVLDYVAEHLKGVRLLEVEPTEDEMTTRRVNYYRRNGYEVLDKTYVQPSYHALEDACPLWIMGSEDSPRLAEQVERIKEEVYRQQVG

SEQ ID NO: 10383 - protein, 235 aa, B.fragilis
FVSPDNKLYNNNQVITNHQLPMKVAYLSSAYLAPVEYYSKLLNYDKIFIEQHDHYMKQTYRNRCTIAGPEGELALSIPTVKPEEPKCPMKDIRISDHGNWRHLHWNAIESAYNSTPFFEYYKDDFRPFYEKKYEFLTDFNEELCRLVCELIDIQPAIERTKEYKTDFAPNEIDFREAIHPKKDFHRTDPEFIPQPYYQVFEARHGFLPNLSIIDLLFNMGPESLLILQKTCADSQ

SEQ ID NO: 10384 - protein, 413 aa, B.fragilis
LIKPTSNKNRLMNQPDIMTLPKDKLFLSEQTWRWYGPDDPVSLWDIKQAGATGIVNALHHIPNGEVWTVEEIMKRKELIESVGLKWSVVESVPVHEHIKTQTGNFRKYIENYKESLRNLGQCGIHIVTYNFMPVLDWTRTDLAYTLPDGSKALRFERAAFIAFDLFLLKRPGAETEYTDEEKTKARIRFEQTDEKEKQLLVRNMIAGLPGSEESFTLEQFQHELDRYRGIDAEKLRTHLIYFLKEITSTADEAGVKLVIHPDDPPCSILGLPRIMSCAEDFQALIDAVPNESNGLCLCTGSLGVSCTNDLEGMMRRFGDRINFVHFRSTQRDAEGNFYEANHLEGDVDMYHVMKAFLELQQRRKVSIPMRPDHGHQMVDDLKKKTNPGYSCIGRLRGLAELRGLEMGIAKSIF

SEQ ID NO: 10385 - protein, 93 aa, B.fragilis
NTATALYQCPLSHMTILMEGNIATQDDTIIQGTFSGDGGADTGYTIISDLYIVTNVDFIHQEIAIAYFGSIPTESSPTDNYVFADMVVIPDNQ

SEQ ID NO: 10386 - protein, 131 aa, B.fragilis
SIHLPPIMTAYIKLLMLCLLFLVFGTQKSSALQPVNNGVAVTTAVKSHTHNVPSFDNSGHDLFDFNQGILLKKSVSDSANPYKQSNNFHPAIKTDAQRPITFKEDTSTYTLRNRVKPAQKYDVFALRHILI

SEQ ID NO: 10387 - protein, 254 aa, B.fragilis
YFGYKVYKVSKTMKIALIGYGKMGKEIEKVALSRGHEIVSIIDINNQDDFESEAFKSADVAIEFTNPMVAYSNYMKAFKAGVKLVSGSTGWMAEHGDEVKELCNKGGKTLFWSSNFSLGVTIFSAVNKYLAKIMNQFPAYDVTMSETHHVHKLDAPSGTAITLAEGILENMERKSVWVKEEAHATNELPIHSIREGEVFGIHTIRYDSEADSISITHDAKNRGGFALGAVLAAEYTAAHEGYLGMSDLFPFLKD

SEQ ID NO: 10388 - protein, 324 aa, B.fragilis
RILQTPSRWLLGRKIKKTMRKVIGIGETILDIIFRNDQPSAAVPGGSVFNGIVSLGRMGVNVCFISETGNDHVGNIILQFMRDNHIPTDHVNVFPDGKSPVSLAFLNEHSDAEYIFYKDYPKQRLDVLFPSINEDDIIVIGSYYALNPVLRDKILELLDIAKEKRAIVYYDPNFRSSHKNEAMKLAPTIIENLEYADIVRGSLEDFYYMYGIKDVEKIYKDKIKFYCPLFLCTAGAERISLRTNAISKEYPVAPLEAVSTIGAGDNFNAGLIYGMLKYDVRYRDLQHLSEETWDKVIQCGQDFAAEVCKSFNNSISGEFAANYR

SEQ ID NO: 10389 - protein, 61 aa, B.fragilis
FISLFLFEVGLISQCVCSVSSLFRYVWDQKLDFLYIAKALNPPSTTATVPVTKLAASLMRY

SEQ ID NO: 10390 - protein, 411 aa, B.fragilis
QITQKMKKHLILSACLIMAISSFAQKKDFSYKFYGQIRTDLYYNSRANEETVDGLFYMYPKDEVFDSNGRDLNATANGSFYTLYTRLGLDVKGPKLGRAMTSAKVEADFRGSGTSYSTIRLRHAYLNLDWGRSALLLGQTWHPLFGDVSPQILNLSVGAPFQPFSRAPQIRYRYTHKGFQLTGAAIWQSQYLSQGIVGKSQTYIKNSCVPEFYLGLDYKANGWIAGAGIELLSLKPRTESKVEDQVYKVNERITTLSYEGHVKYSNKDWFVGAKTVLGSNLTQTSMLGGFGIKSIDNRTGEQKYTPIRVSSSWLNVVYGQKWKPGIFLGYVKNMGTSDALASNQVYGTGTNVDQVVTAGAELTYNVNHWKFGVEYTYTSAAYGSLYLKNGKIIDTHYVGNNRIVGVAMFMF

SEQ ID NO: 10391 - protein, 528 aa, B.fragilis
LKKQNMKLDRFINRPVLSTVISIVIVILGVLGLLSLPISQYPDIAPPTVRVNTTYQGANAQTVLNSVIAPLEEQINGVENMMYMTSTATNTGEASIEVYFKQGTDPDMAAVNVQNRVAKAQGLLPAEVTKVGVITSKRQTSMLLVFSLYSSDDKYDNEFLENYAKINLVPEVQRVPGVGDAMVLGADYSMRIWLKPDVMAQYHLMPTDVSAALAEQNIEAAPGSFGEQGKQTFQYTLRYKGRLQSQEEFENIVIRANSDGQVLRLKDIATIELGRLTYGFSNNVNGHPAVTVIVFQTAGSNATAIINDILDLLEKSESTFPPGVKVNISQNANDFLFASIHEVVKTLIEAFILVFIVVYIFLQDLRSTLIPAIAIPVALIGTFFVLYIIGFSINLLTLCAMVLAIAIVVDDAIVVVEGVHAKLDQGYKSARLASIDAMNELGGAIVSITLVMMSVFIPVSFMTGTSGTFYRQFGLTMAIAIALSAVNALTLSPALCAILLKPHDPDAKKKSILATVSMLRSMLLMTQY

SEQ ID NO: 10392 - protein, 284 aa, B.fragilis
RSHKTRSLTFKSNSMANLFSVKDKVVVITGGTGVLGKAIAAHLAEEGAKVILLGRKTEVGNKIVESIRTQGGEALFLTTDVLDRKILEQNLADILKAYGRIDALLNAAGGNMPGATISPTGDIFDLKIDEFQKVLDLNLTGTILPTQVFLKPMVEQRAGAIVNFSSMAAFRPLTRVAGYAAAKAGISNFTAFMATEIAKKFGEGIRINAIAPGFFLTEQNRALLTNPDGTYTQRGQDVIRQTPFGRMGRAEELCGTIQYLISDAASFVTGTVAVVDGGFNAFAM

SEQ ID NO: 10393 - protein, 394 aa, B.fragilis
TSLKIEYKEGMKSKIVLFAFCLALLSGCGKKGFNMGGTPECAVETLQPTTVNLKSSYPATIKGKQDIEIRPQVSGFITKLNIDEGSMVKKGQVLFVIDPVQYESAARAAKAAVATAKANVSTQEITVKNKRELNKKNIISDYDLEMAENTLASAKAQLASAEAQLISANQNLAYTRVTSPSDGVAGTIPYRVGSLVSASSPSPLTVISDITQMYVYFSLTEKELLNLIRQDGSQTEFLNSFPAVQLTLADGTLYADSGKIETVSGVIDQNTGAVSMRATFPNHGHLLRTGGTGNIQIPYSKENVIVIPQKATYEIQDKKFVYLLQPDNTVKNTEIEILNLNDGQNYVVTAGLKAGDKIVVENVSTLKDGATIKPLTQQESAERFKAALEERKNQ

SEQ ID NO: 10394 - protein, 312 aa, B.fragilis
SMGKGLKWIIAFAGAMVIVLLLRGFAFTSCLIPSAGMENSLFQGERILVNKWSYGLRVPYMSLFSYHRWGESPIHKDDIVVFNNPAGIKEPIIDRREIYISRCIGVPGDTLLIDSLFNVVDRSTQLGPDRKQLYTYPQTKEQQLDSLLSILSIGPNELMGQHEGKNVRSFSRYEYYLLDQAMNGKSWIQPLQQSLQEEAKPLIVPGKGKAVRVYPWNRTLLRNTLVLHEGKQAEIRNDTLYIEGRPSQHCYFTKDYYWMASNNSVNLSDSRLFGFVPQDHVIGKASRIWFSKTDHTGIFSGYRWERFFQPVK

SEQ ID NO: 10395 - protein, 491 aa, B.fragilis
  UNSURE (338): Identity of amino acid sequences at the above locations are unknown.
NLLNGKTSIIRMQKQKLNNTLNRNKEKNMKKQIIGMLCATALLSSCHIYKSYDRPKDIEASGLYRDTVSVADTLVSDTVNFGNLPWREVFTDPQLQALIEQGLTHNTDLLTAALKVKEAQASLMSARLAYAPSLGLSPQGTISSFDKHAATKTYSLPATASWEIDLFGKLLNAKRGAQVTLLQTKAYRQAVQTQIISGIANTYYTLLMLDRQLDITEQTADIMKRNVETMQAMKDAAMFNTTSAGVEQSKAAYAQVLASIPAIQKSIREAENAMSMLLAQAPQTIKRGVLEEQQLPEDFSVGVPLQLLSNRPDVKAAEMALAGTYYNANSTRAAFYPXITISGSAGWTNSAGSAIINPGKLLASVLGSLTQPLFYRGANIARLKIAKAQQEEAKLAFQQSLLNAGSEVSNALYQYQSASEKTASRKLQVESSEKASEYTKELFKLGTSTYLEVLSAEQSLLSARLSQVNDTFDRMQAVVSLYQALGGGRED

SEQ ID NO: 10396 - protein, 312 aa, B.fragilis
KQMNTLPIHLAPLQGYTEAAYRNAHAAVFGGVDVYHTPFVRIDRGEFRHKDVRDILPENNRVPHLIPQLIASEMDKTERIIALFIEQGYREMDINLGCPFPMLAKRQCGSGMLPHPDKVETLLKQIEQYPDVSFSVKMRLGWEKPDECLTLLPLLNAAPLTEIIVHPRLGIQQYKGEVNMEGFTAFYEACRHPVIYNGDILTIEDIRCITEKFPKLTGVMIGRGLLANPALGWEYKEGKKLTPEEWREKLRALHTAVFQHYETQIQGGEAQLVTKMKTFWEYLAPQIDRKSWKAIHKSTTLAKYNIAVRSAF

SEQ ID NO: 10397 - protein, 564 aa, B.fragilis
  UNSURE (473): Identity of amino acid sequences at the above locations are unknown.
KEIDFGNRFHASFNAAYDPVLKKYKKRVLFFIQKPVLTIGSVVVGFALLIFLMKVTPTGLVPNEDTGTIMAVVDMPPGSSLERTQEVMWQVDSLLASDPAIESRTMIAGYSFIAGQGPSYGSFICKMKNWDERSIAQRSDFVSGMLYLKAREVIKDARVLLFAPPMIPGYSVSNGFEMNLQDKTGGSLDKFYEVAQDFITKLQARPEIQSAQTSFNPNFPQYMIDIDAAACKKAGLSPSDILTTLQGYYGGLYSSNFNRFGKMYRVMIQADPNSRTNLESLNSVKVRNGNEMAPITQFMSVKRIYGPDNIKRFNMFTAMTINGSPADGYSSGQAIQAMQEVAEQTLPTGYGYEFSGMTREEQSSSGSTTAMIFVLCFVFVYLLLSAQYESYILPFAVLLSIPFGLAGSFIFAHLMGLANNVLPILGAATNNIYMQIALIMLMGLLAKNAILIVEFALDRRKMGMSITWAAVLXAGARLRPILMTSLAMVVGLLPLMFAMGVGANGNRALGTAAVGGMFIGMICQIFVVPALFVIFQYLQEKVKPIEWEDIDNTDAETEIEQYAK

SEQ ID NO: 10398 - protein, 208 aa, B.fragilis
RYKDMKKLIIFDLDGTLLNTIADLAHSTNHALQTLGYPTHEVASYNFMVGNGINKLFERALPEGEKTEENVLRVRKEFLLHYDRHNADESRPYPGIPELLETLQHKGYKLAVASNKYQAATEKLIAHYFPGIRFVAVFGQREGVKVKPDPAVVHDILQIADVSKDEVLYVGDSGVDMQTAINSGVTSCGVTGGFRPRTGLGIRLAGIL

SEQ ID NO: 10399 - protein, 171 aa, B.fragilis
VKVEQIHRKKGKLVTSGMGKAGQIAMNIATTFCSTGIPSVFLHPSEAQHGDLGILQENDLLLLISNSGKTREIVELTQLAHNLNPGLKFIVITGNPDSPLASESDVCLSTGHPAEVCTLGMTPTTSTTVMTVIGDILVVQTMKRTEFTIEEYSKRHHGGYLGEKSRKLCVK

SEQ ID NO: 10400 - protein, 1030 aa, B.fragilis
LLTECLAMCSLATMAQHDEWKNPEINAVNRAPMHTNYFAYSSSEEAAKADKENSSNFMTLNGIWKFNWVKNADARPTDFYRTDYNDKGWGQMKVPGVWEMNGYGDPIYVNVGYAWRSQYKNNPPYVPIENNHVGSYRKEIIIPAEWSEKEIFAHFGSVTSNMYLWVNGKYVGYSEDSKLEAEFNLTKYLKPGKNLIAFQVFRWCDGTYLEDQDFFRYSGVGRNCYLYSRNKKYIQDIRVTPDLDSNYTNGTLNVALNLNGSGTVELNLTDPAGKSVATAQVNGNGQKSVVMDVSNPEKWTAETPNLYTLTATLKNGSNTLEVIPVKVGFRKIELKGGQILVNGQPVLFKGADRHEMDPDGGYVVSRERMLQDILRMKQLNINAVRTCHYPDDNLWYDLCDQYGIYVVAEANIESHGMGYGKETLAKNPSYKKAHMERNQRNVQRGYNHPSIIFWSLGNEAGYGPNFEQCYTWIKNEDKTRAVQYEQAGTNEFTDIFCPMYYDYDACKKYSEGNIDKPLIQCEYAHAMGNSQGGFKEYWDLIRKYPKYQGGFIWDFVDQSNHWKNKDGIDIYGYGGDFNKYDASDNNFNDNGLISPDRRPNPHAHEVGYFYQSIWTTPGDLSKGEIKVYNENFFRDLSAYYMEWQLLANGEVMQTGVVQDLNVAPQQTATLKLNLNTEKVCPCKELLLNVTYKLKAAETLMPAGSTVAYDQLTIRPYTAKALELKNQKASNLDIVVPVIKDNDHNYLIVEGENFIIEFNKHNGYLSRYEADGMQLLNPGAQLTPNFWRAPTDNDYGAGLQHRYAVWKNPGLKLTSLKQSIENEQAIVQAEYEMKAVKGKLFLTYVINNEGAVKVTQKMEAGKEEKVSDMFRFGMQMQMPENFNEVEYYGRGPVENYADRNHSTLIGKYRQTVAEQFYPYIRPQETGTKTDLRWWRVLNISGNGLQFVGDAPFSASALNYSIESLDDGVQKDQRHSPEVAKAPFTNLCIDKVQMGLGCVNSWGTLPLEKYRVPYQDYEFSFILTPVRHKVNM

SEQ ID NO: 10401 - protein, 450 aa, B.fragilis
LYRLYIQNISRKDKIFITFVEHINVLLTMEQLLHYVWKHKIFPLHELQTTTGLPVEVIDTGLPNSDSGPDFFNAKLKIGGTLWVGNVEIHTASSDWFRHGHDRDIAYDSVILHIVTEIDCEIYRSNGEPVPQLRLPCPEQVKEHYDELCRADIHPPCYSILETLPKLTIHSWLTALQTERFDQKNRTITRRLQRCNQHWEDAFFITLARNFGFGLNGDAFETWANLLSFRAIDKHRDDLTQVEAFFFGQAGLLEGESADDYFSWMQKEFRYLQHKFELPPVMNPSLWRFLRLRPGNFPHVRLAQLASLYYREHSLFSRVMEAETLKDLKQIFAGHTSAYWEEHFMFGKSSPRREKSIGAGAKELIIINTVIPFLYAYGLHKADERLCERAASLLEELKAENNYVTRMWSGAGIPVQTAADSQALLQLQKEYCDKKKCLYCRFGYEYLRHK

SEQ ID NO: 10402 - protein, 74 aa, B.fragilis
ELFRLTVVGCNVSTAHSGVPPMLKPFLPQPDNKAKQNANKTILLFIPSLYSIFNDVHFVAKWFIVITLSGIDEN

SEQ ID NO: 10403 - protein, 275 aa, B.fragilis
ASIRHWAAEEKINFKYNTIMISPLASIAPGAKIGKNVIIQPFAYIEDNVEIGDDCIIMPYASVLNGTRLGKGNKVYQHAVLGAEPQDFHYKGEESSLIIGDNNHIRENVVISRATFGGNATKIGNGNFLMDKVHICHDVQIGDNCVAGIGTTIAGECTLDDCVILSGNVTLHQYCHVGQWTLVQSGCRISKDVPPYSIMAGNPVEYHGVNAVVLQQHKNTSERVLRHIANAYRLIYQGNFSLQDAVQKIIDQVPMSEEIENIVAFVKESKRGIVK

SEQ ID NO: 10404 - protein, 433 aa, B.fragilis
TTISFIVFLCPQPNLIVRMKQLSTRAEMQYNIHTLSNGLRIIHEPSSSKVAYCGFAVDAGTRDEAENEQGMAHFVEHLIFKGTRKRKAWHILNRMENVGGDLNAYTNKEETVIYSAFLTEHFGRALELLGGYRFPFHLSAERNRKRDRGDIDEIQSYEDTPSELIFDDFEDMIFRNHPLGRNILGRPDLLKKFRSEDAMAFTSRFYQPSNMVFFVLGDFNFQKIVRQVEKLLVDLPLVTVENQRTIPPLYVPEQLVVHKETHQAHVMIGSRGYNAYDDKRTALYLLNNILGGPGMNSRLNVSLRERRGLVYTVESNLTSYTDTGAFCIYFGTDPEDVDTCLKLTYKELKRMRDVKMTSSQLMAAKKQLIGQIGVASDNNENNALGMAKTFLHYNKYESSESVFRRIEALTAEGLLEVANEMFAEEYLSTLIYR

SEQ ID NO: 10405 - protein, 498 aa, B.fragilis
KINIMRKATRTQWIKCSIAILLYLIFLIWVKSWWGLIVVPFIFDIYITKKIPWSFWKKSKNPTVRSVMSWVDAIVFALVAVYFVNIYVFQNYQIPSSSLEKSLLVGDFLYVSKMSYGPRVPNTPLSMPLAQHTLPILNTKSYIEWPQWKYKRVPGFGKVKLNDIVVFNFPAGDTVALNFQDADFYTLAYNIGKQIYPNPIDMDSLTREQQKTVYDLYYNAGRKEILSNPQRYGKVVTRPVDRRENYVKRCVGLPGDTLQIINGQVMIDGKAIENPENLQFNYFVQTTGPYITEEMFRELGISKADQRLTPEGASYEEGLIELGLDGRNAQGGLNPVYHLPLTKKMYDTLSGNKKLVGKIVIEPEEYSGEVYPLNLNTHWNRSDYGPIWIPAKGATITLTPDNLPIYERCITAYEGNKLEQKEDGIYINGVKTNQYTFQMDYYWMMGDNRHNSADSRYWGFVPEDHVVGKPIVVWLSLDKDRNWFDGKIRWNRIFKWVD

SEQ ID NO: 10406 - protein, 112 aa, B.fragilis
RSYFLWSYGGISPPYRTWNPSGRNFIGKQGGKLILIMVWDENQKGEPGKRRKGLWVLPLIEKETDISLRVFDLRPRPWARNYPGFYEDKRLLDRSILRAIWTRTFFDINVAC

SEQ ID NO: 10407 - protein, 371 aa, B.fragilis
LYHVTRIPIFAISAFRQIQTMYKNLFNLLTILLILPSCTDMSPNISVVCEENNIGNCILKWETTPLIKGQVKVYTSDNPEFIPEDNPVAMANISDARMTIVTNDPSRRSYYMLVFNDKYCVKVAPRNVNMPGIQNFRDLGGYKSATGKHVRWGKLYRSAQIDSLHCFALRKLQNLGIKTILDLRSESELHNTPPLQKGFNVVHIPINTGDMEHILHGIQQEKIKTDTIYHMVEAMNRELVAKYQKEYKEIFDILLDKNSYPVVIHCSSGKGRTGIVSALILASLDVNADIIMEDYRLSNDYFNIPKASKYAYNLPVNSQEAITTLFSAKEDFLNAAKDEIERKYGDVPTYLRKAIGLQSEDIHRLRTILLE

SEQ ID NO: 10408 - protein, 214 aa, B.fragilis
TMKVKKISIANVEVDALPELLDKEKIGFQPIDNVNWEAYPYRPKVEFRIAHSDDAVLLHFNVKEASVRAKYGEDDGSVWTDSCVEFFSVPTGDGIYYNIECNCIGTILIGAGAERNNRERASREVTDQVKRWASLGRQPFDERIGECNWEVALVIPYTAFFKHHITSLDGKTITANFYKCGDELQTPHFLSWNPIKIEKPDFHRPDFFGTLEFE

SEQ ID NO: 10409 - protein, 485 aa, B.fragilis
  UNSURE (467),(474),(476),(481),(483): Identity of amino acid sequences at the above locations are unknown.
CVSLHPKIKIYRDLMKTFEELGVSPEIRKAIEEMGYENPMPVQEEVIPYLLGENNDVVALAQTGTGKTAAFGLPLIQKINVKNRIPQSLVLCPTRELCLQIAGDLNDYSKYIDGLKVLPVYGGSSIDSQIRSLKRGVHIIVATPGRLLDLMERKTVSLATVTNVVMDEADEMLNMGFTDSINAILADVPQERNTLLFSATMSPEIARISKNYLHNAKEITIGRKNESTSNVKHVVYTVHAKDKYAALKRIVDYYPQIYGIIFCRTRKETQEIADKLMQEGYNADSLHGELSQAQRDTVMQKFRIRNIQILVATDVAARGLDVDDLTHVINYGLPDDTESYTHRSGRTGRAGKTGTSIAIINLREKGKMREIERIIGKKFIAGEMPTGKQICEKQLLKVIDDLEKVKVNEEDINDFMPEIYRKLEWLSKEDLIKRMVSHEFNRFVDYYRNREEIEVPTDSRRSSPRGXMPTLFSXFXTLSIXPXPL

SEQ ID NO: 10410 - protein, 144 aa, B.fragilis
QRGPFYFYSPFETGGKPMKRLVVLLFGLVGAALFMSAANSGDRVLRDSIFHVYRSMPADTTRTVFAKEAAMGHVKESWALELLDSALVFAREIKDVEGELELQYGIFRYYTFRMDGENMEKTCATLREACYRYVFTTGLEGAAL

SEQ ID NO: 10411 - protein, 375 aa, B.fragilis
VIFANLTQNIKMKQLILSGMFVVCGLSVSLASEKWAVDSINWHRAEQKMQEKDFQDAALTYKELITKGDSLFVDYAGRHVEDMREQYSIDELDLQNGMQQKKIWKLVFITILCLAVLLFVGLLYLRRAERKLLFSREELQKAKRLAEESVRNKSVFLSNMSHEIKTPLNALAGFSEILITPGIDDEVRAQCNDVIRLNSDLLLHLVNDVVDVSCLDVANMRFSVVPHEVVALCRNVVEMLRNIKQTSAEMIFETELSALEMETDPCRLQQVLINLLVNATKFTKEGYITLTLRINEAGVPEFMVTDTGCGIPLENQEAVFSRFEKLNEGIQGTGLGLSICKLIINRMGGDIRVDSTYSKGARFIFTHPLKQEENR

SEQ ID NO: 10412 - protein, 124 aa, B.fragilis
PRNKYAFIVVNYANGDMVGHTGIYEAIEKAVVAVDACVKDTIEAAKAQGYEAIIIADHGNADHALNEDGTPNTAHSLNPVPCVYVTENKEAKVADGRLADVAPTILHILDMVQPAEMTGCNLIK

SEQ ID NO: 10413 - protein, 186 aa, B.fragilis
NKLSNPMHTTILETERLLLRPFRETDLQELFECCQNPNLGNNAGWEPHKNIEDSKEVLHTVFMGNEGVFAIILKEDNSLVGSIGIITDPKRENTRTRMLGYWLKECHWGKGMASEATRTILDYGFNVLGLHLISANCYPHNTRSRLLLERNGFVYEGILHEAEMTYDGHVYDHLCFYQKKGRVPMD

SEQ ID NO: 10414 - protein, 65 aa, B.fragilis
HRVPQSELNLLITNDADLWRIRVLTHPHLVYSLYLFKKRKKIHPVTLVTNYLYLISDLCPLNNKR

SEQ ID NO: 10415 - protein, 115 aa, B.fragilis
NEKTNKNMEQSFKKGIVLHLASLVEYSEGGIISKQLIKSPAGNITLFSFDKGEGLSEHSAPFDALVQVLEGSANIVVNGQVFTVNAGESIVFPANAPHALTAIERFKMLLTMIKE

SEQ ID NO: 10416 - protein, 404 aa, B.fragilis
SNRATMNSKKVLFIIFICTLTVTGCDTQEQTTIDSGLTLIRATQTLDSLYANYSVSGTCLLIENYPSNVGNYTATYLASEEQKEIPNQYSYLWPYSGTFSAVNALWAATGDESYKTLLDNKVLRGLEKYLDISRSPAGYASYINTASQSDRFYDDNIWLGIDFTDAYLNTKEEKYLKKAQLIWEFIESGADDKLGGGIYWCEQKKVSKNTCSNAPASVFALKMFKAIRDSSYLIKGQELYEWTKKRLQDSTDYLYFDNISLDGKIDKSKYAYNSGQMMQAATLLYQLTGCSHFLKDAQNIAKACYNYFFINFIPEEGEPFKLLKKGDVWFTAVMLRGFIELYQTDHNKTYINSFNQNMDYAWEHVRDEKGLFDIDFSGRTHDDRKWLLTQAAMVEMYARLAVTK

SEQ ID NO: 10417 - protein, 310 aa, B.fragilis
YDMAKIQIKSEKLTPFGGIFSIMEKFDSMLSPVIDSTLGQRCSSIFGYQFSEIVRSLMSVYFCGGSCVEDVTSQLMRHLSYHPTLRTCSSDTILRAIKELTQENISYTSDQGKTYDFNTADKLNTLLINALVSTGELKEIEEYDVDFDHQFLETEKYDAKPTYKKFLGYRPGVYVIGDKIVYIENSDGNTNVRFHQADTHKRFFALLESQNIRVNRFRADCGSCSIEIVSEIEKHCKHFYIRANRCSSLYNDIFALRGWKTEEINGIQFDLIPFLLRNGKASAIVLSSRDKDATVATLTCGKANTLTDAF

SEQ ID NO: 10418 - protein, 229 aa, B.fragilis
NYSYHPNRESSYFFCLYNQEINYKTKNRKHMQKVLFITTILLTLFALSIRAEHNPRKRPDVSAQFQTVSGHSISLNGIGLAYSYEYAFTPKGTIIFSAGSSYAFGRILQLKMESLREFHIDTKDYHLVTGDLAIEPRFYYNLKKRHRNGKRTWGNSGGYLSVNFGYSFPITITSGVKAAHIYVITPYWGFRRVWKHFLFDLSGGVGYIGSSNRTSAVYPGLRIGLGYRF

SEQ ID NO: 10419 - protein, 429 aa, B.fragilis
AMNYTYRQIWLINYPVMLSILMEQLINITDAVFLGHVGEVELGASALGSIYYLAIYMLGFGFSLGVQVMVGQYNGKGHYTGTGGTFFQGLVFLCVLAILLSLSSYFFSPFLLRYFVHSSEIYCAVIDYLDWRCFGLLFSFPFLAFRSFYIGIVRTNALSWAALAAVLINIPCNYWFVFVLDRGIAGAAIASSLSEAASLLIIVVYTWLKIDRTDFGLKFIFDKCLLVELWHLSVWSILHAFISVVPWFLFFVVIERLGEAQLAVSNIIRSVSTIFFVIVNSFAATTGALVSNLIGAGERQYLFPLCRKILKLGYAIGLPLVVLAMVFRRQITGFYTDSSQLINISSIPFAVMLLNYVFALPGYVYINAVTGTGKTRIAFWFQLITIVIYLFYLYLLSHYTASLAVYLTAEYLFVILLAVQSVLYLRISS

SEQ ID NO: 10420 - protein, 83 aa, B.fragilis; identical to SEQ ID NO: 6082

SEQ ID NO: 10421 - protein, 84 aa, B.fragilis
FAYKESSVCVARIRVKPLSIVVCSCVSHPVTVNVQMKMMKSTFFEFIVALLDYYCVSLLSFKEDIFKISSFPLFIKPLSPNQFL

SEQ ID NO: 10422 - protein, 231 aa, B.fragilis
KYKKMKKLIYTLCLFTGMAISSCEDWLARDPLDQIADVNLTYTADECKLYVNQFYTSFWGSPNNYIYHIDRGSDNLLSDNYQDNKDLIEGLHQVPSSGEGWGTTEWGKIRSVNFLLDNCDKSPEPEKARKYIGEAYFFRAMLYYEQFLRKFGGAPWIDKTLDLESGELYGPRLKRHELADKILNDMDDAIDRLPTYSQQETGRVSKEAAMLYKARIALLSSPRGWKEQRIS

SEQ ID NO: 10423 - protein, 630 aa, B.fragilis
IMKNKSIASFMIKIVMMPLLFTISCVNEISEDPVDIPGEIPIRLSTQILCNHTRAINNEFQEKDAIGLYVLTQLSTINQKRYIDNMRFTCSQATGFEPEETIYYPKGDGKCDFISYYPFQETGINQDQSIMQVQIHTDQSSVSKHSLSDFMIATNSDITPSQNMVSMEYKHKLCKLKITIKPAPGEDIDELLNDNPSLSLNGFHSDASYDFLTDRFEPSGQTISVTPHGEWKIENNALTGKEVILIPEKIESDNHYINIDINGKSYSCPFPDNFQLASEKNCSIAIIYKSSEGIQINNFDHSITDWTEGDSGETTAQETSGVIHLSALKFSKSNVYKAINEGTQVAEICKEYLLADNIDAQAIVVYPVLNGATDLNNGTVICLLDEPASIHGGKVSWNKVNNALDYTPGNQSIISDFYITQDNSISISKPENPLPVRLQEEVLTDIRNTETQTYPIVKIGIQYWMGRSLEATHYTDGKAITLKKDFTTTAGYYTGKFKDAPQDFYFYNSEAVISGKLSPQGWSIPTETEWELLKQYINNDASKLKFGPWSSDENGDKLPILNITGFNGVPEGYILKSKNGYTNGLYTVVYWSTNSSGNQTNRAIYLLHTTNEIKDGNITDRALSVRCIRK

SEQ ID NO: 10424 - protein, 277 aa, B.fragilis
QILKQTVYVSINPQNHPIMNRFENKIIIITGAAGGIGASTTRRIVSEGGKVIIADYSREKADQFAAELSNSGADVRPVYFSATELKSCKELITFTMKEYGQIDVLVNNVGGTNPRRDTNIETLDMDYFDEAFHLNLSCTMYLSQLVIPIMSAQGGGNIVNVASISGITADSNGTLYGASKAGVINLTKYIATQTGKKNIRCNAVAPGLILTPAALNNLNEEVRKIFLGQCATPYLGEPQDVAATIAFLASEDARYITGQTIVVDGGLTIHNPTINLV

SEQ ID NO: 10425 - protein, 71 aa, B.fragilis
NKTKQAFSIPLYNKCNRTIAKVTYTIEKYNIHSNILNDGSLECTGQHIIISVAVFSFFPYFLHLFYKCFHL

SEQ ID NO: 10426 - protein, 320 aa, B.fragilis
FIDDFESKMIFILLLVQYQRSISLFYLLIIKGNIMKKNLLLVGALVSAFLLASCSGGDKSKAPVVSTADIENAAEVIKYYNTSLGVLKDMVKEKDVNAVLDYMEQKGKAPALSAIVPPAVVSKDSAIVLNPGNCFNEETRQNLKQNYTGLFQARTEFYANFDTYLSYLKKKDVTNAKKLLDVNYQLSTQMSEYKQNIFDILSPFTEQAELVLLVDNPLKAQIMSVRKMSSTMQSILNLYARKHRMDGPRIDLKVAELTQQLDAAKKLPVVNGHEGEMKSYQAFLSQVETFIKQVKKVREKGEYSDADYDMLTSAFETSII

SEQ ID NO: 10427 - protein, 90 aa, B.fragilis
KRAEGFGLKSLLLTPLQPPVKTFSYMLFVLIYFPCIATLVAIKQESGSWKWAIFTAGYTTALAWLVSFAVYQIGGMFSPIAWMSNLLMMV

SEQ ID NO: 10428 - protein, 156 aa, B.fragilis
RNMDKVIINSYEDFEKLIGQQIGVSDYLEVSQERINLFADATLDHQWIHVDTERAKVESPYHSTIVHGYLTLSLLPHLWNQIIEVNNLKMMINYGMDKMKFGQAVLSGQSVRLKASLHSLTNLRGVAKAEIKFAIEIKDQPKKALEGIAIFLYYFN

SEQ ID NO: 10429 - protein, 286 aa, B.fragilis
IMEGKKTTQEEYQKCVNAVVDYINLHLGEEIDLKSLARISHFSPFYFHRIMKAFLGEPIGTFIVRTRTEAAARLLRYSSTSISDIAYRIGYASPSSFSKIFKQMYGISPTEYRNNKNYVIMKPAIIKPDLELKKEIRELPQRNVIYIRLFGDYKLNDYAGTWMHLIQFVKEQNLPMGDPSPLCIYHDDPKVTPTDKLRTDVCMLLPSNARPKGNVGFKQLPAGRYATFLYKGSYDQLQAVYDTIYGKYLPEMECTLSDEPSAERYLNDPSCTPPEELLTEIYIPIR

SEQ ID NO: 10430 - protein, 134 aa, B.fragilis
NIRMNVILFDGICNLCNGAVTFVVKRDRKGLFRFVSLQSETGKSLLKRYAVESTNKTLYYFRNNRCYSKSTAILYILKDLGGFWQCLYPLILIPAKLRDAIYLLVSKYRYRIFGKADSCIKPFGFSSEESKRSD

SEQ ID NO: 10431 - protein, 245 aa, B.fragilis
KNNVLGKFILDFFNIFVEIKSYLNTMNVKIESSWQQRLQEEFDKPYFEKLVNFVKNEYGKAHILPPGHQIFHVFNSCPFQNVKVVILGQDPYPNPGQYYGICFSVPDGVAIPGSLSNIFKEIHQDLGKPLPNSGNLDRWVKQGVFPMNSVLTVRAHETGSHRNIGWETFTDAVIKKLSEERENLVFMLWGSYAKEKASLIDTDKHLILTAVHPSPRSADYGFFGCKHFSKANTFLRSRGIEEIDW

SEQ ID NO: 10432 - protein, 1062 aa, B.fragilis
KINVFLIKVSIMKIKKHILIPLMVLLLFGSMDAMAAIEQAIQVKGKVVDNIGEPVIGANVVVKGTTTGVITSIDGSFAIDAVKGSTIVVSFIGYLSQEVKVTGNFLNITLENNTELLDEVVVVGYGVQKKANLTGAIATVGAKELEDRPVTNAAAALQGKVANLNISNGDGGPGKKASFNIRGYAGLDATYSPLVIIDGVTGYFDDLNPNDIETLTVLKDAAASAIYGAQAAYGVILVTTKSGKKNEKTVINYNNNFSFNSPTVLPKTPGSLEFSRLFREADINGGGSGIIDLETMERIEKYYYDPTSIPNNVPQRDNPDRWADWGDGRSNANEDWQKAMFKNNQLNQQHNISIRGGSDKTTYVMSLGYLKDEGKLRYYDDHYQRYNALAKITTDVTKWLTVGLNVRYSHEKSVSPAYGMNPGGSVNDMIGWTQVVWPTIPVRDPNGHFSPAGRMVFIADANPQTSYTDNFWGTANVVIKPLKGWTINADFTYNKWMNKRSYSKGLIYSYSVSNEPYLEGGFGTEDTRVWQESNNDDFTSMNAYTTYEKEFKGHNFKIMAGMQSEYKKNFGLYANKMGMVLPGQPSISTSTGKIEAWDSLDHYATLGFFGRFNYDYKSRYLFEFDLRRDGSSRYAKGHQWGTFPAFSAGWNVAKEAFFEPYTSILSELRLRGSWGELGNMRGKNYQYISTVPYNATTDYIMGDKRISAFGAPNMIAYNTWEKNRTLDFGVDIAALNNRLTMSFDWYRRDIIGLITKGVTLPAVLGVNSPDTNNADIRNEGWELTLGWRDQFSLASKSFNYSVSFNLSDYQGTVLKYSNPKGLIYDYYVGKKMGTIWGYTTDHIMTDPAEAKAINDSGVQNKFGGDWVVGDIKYVNLDDDPNINDGNQTLEDHGDLSIIGNDTPRYNFGFGFNADWNGIDFSMFLQGTMKRDLWLEGPVAFGLGGGQWGSNVWKNTLDCWREDGSNPDPWLPRLYLWSTSKNLQKQTRYMDTGAYCRLKNIQLGYSLPGAIINKVGLEKVRIYFSGDNLLTFSGINENFDPEAPWGGAYPISKSISFGVNVTF

SEQ ID NO: 10433 - protein, 105 aa, B.fragilis
RHPVRPHSILVEKWEGKCYRLVIQRQRRNSGDLDLWEGEYTYRCILTNDYKSSTRDIAEFYNLRGGKERIFDDMNNGFSWSRLPKSFMAENTVFLLLTALYTIYY

SEQ ID NO: 10434 - protein, 246 aa, B.fragilis
KMKVMKDYKLMAVGQIVADCFDYAKVFNKYGIDFCCNGDVSLADACGKMGIDADCLLEELKQIKSEQSLTLDFKSWPIDLLVDYILKFHHRNIRYQGPQILQLLDRVCEAHARKHPELYEVRELFQESWIDLNNHLTKEEMVLFPYIYDLFDAVAQHRPIPAFHCGSVSSPISVMMSEHDAEGERFRRISGLTHGYLVPGDACSSYRLLLEMLRTFEDNLHHHIHLENNIVFPKAIELQENCERMC

SEQ ID NO: 10435 - protein, 67 aa, B.fragilis
FEKNGLNLRLSYNFASAFIDGMGEDTFHDRYYDRVNYLDVNASYTFAKHYTLYAESNNLVETPLRFY

SEQ ID NO: 10436 - protein, 815 aa, B.fragilis
RLSVMGGHLYADEKANVVKQGTIRGRIIDTSKQTLPGASIYIENLKTGVISDVNGFYTFANLNPGTYTVKVTYVGYAPVEMKITIPEGKTLERDVILNEGVELQEIVIGGAFQGQRRAINSQKSSLGIKNVVSADQVGKFPDSNIGDALKRISGINVQYDQGEARFGQVRGTSADLSSVTINGNRIPSAEGDTRNVQLDLIPADMIQTIEVSKVVTSDMDADAIGGSINLVTKNSPYKRTLTATAGSGYNWISEKAQLNLGLTYGDRFFNDKLGVMLSASYQNAPSGSYDTEFLWEKDDKGNVYINDYQIRQYYVTRERQSYSAALDWDISENHKLMFKGIFNNRNDWENRYRTTLKDMDEEGKATVRVQTKAGTPDNRNARLERQRTMDFTLGGEHLFGPVSMDWNASYAKATEERPNERYIDFQLKKQQFDMDLSNEREPLATPKSGSTMTLNKDFGLKELTEQQEDIKEKDLKFSMNFKLPFRNGNKLKFGAKVVRKTKDKEVDFYEYTPKDEEAFMANSLQNTVDQTNKNFMPDHKYQAGIYADKQYVGSLDLNNPSLFDKEQVQEELAGNFEARETVSSGYIRFDQKLTDNVELMTGLRIENTSLSYTGRTYDDETDQTSKTARETNSYINFLPSLLMKWNVNEDFKVRGSFTQTLSRPKYSALVPSVNIKRSDNEVTVGNPGLKPTLSYNFDLSADYYFKSIGLVSAGVFYKKIDDFIVNQVSTNYEYNGNLYNRFIQPKNAGNANLIGMELSYQRDFGFIAPALKCIGFYGTYTFTHSRVEDFNFEGRENEKDLSLPGSPKHTANASL

SEQ ID NO: 10437 - protein, 74 aa, B.fragilis
FLVLMELGKYPGRGVKAKRIKTVEINHLINYKYGKSKLVQCKPHVGQERWRFDNQCGCSHRTCSTKYSSYRNSG

SEQ ID NO: 10438 - protein, 134 aa, B.fragilis
RLPLRKGRPCQVKLRSLKLLQPYDLDKEQELVPMTPQQATWKVFTYFDRDMELRVQELREQPGIIRVDVVAKEVLTRPEEGDFDMYPPPSLQDVADRRKIMYTYKGKLKYRPYPPGLTQEEVVNYRAGVIAVKI

SEQ ID NO: 10439 - protein, 399 aa, B.fragilis
VRMSFEIIRKTGEIAFVANPIAFEVKTSGEAEIEIRLRVGAQEVFSASYVPFGDRIHFDIAEILQPFVTSGPLEDSEDLILPVSGFMAGYTLEVKGRETRTLTGKVICGGISKQAAREMAGRGTDFILNRLRDYSSQFLFTTRTRGKHIAIRETEVSPLIFIHPDKRIQVESEYGNRIKLPEGTAGEVYALNIGRIRREFFHRYNQIVSFIRVLVPAEEAFDISFTPGEVSENGLSFLFRNSLGCYEVIEMPGKMIYSLDRGDDENYRTFDEEGGDYITGRPRPDLLQKMKLNTGFKRKTELKFIQDLLSSDDIRLLNGTARRRVLVTCEEYGYEEPMKEPTSLVLDIEVAERESNYTPDMDGENAPPFIELLPGEVEIPSEGGQVRVRVESNIMWEVV

SEQ ID NO: 10440 - protein, 144 aa, B.fragilis
ITSMAKASWCNVSPMSGKRDGVLTISAGAHTGRVARNTVVTVTAANGTRPSASIAVSQAGAGVFPTMDTSKPDLSSSRGVVNINGTSNISKLKWTCPARIMGVDMPIDGNYFKNGGKTVGILGNNGGYSGEPRTLGPFKLCWRL

SEQ ID NO: 10441 - protein, 253 aa, B.fragilis
IIFAVRYMEGEAGNNNNLFTYAMATGSTKDNYLANGEKFLDALNIANTGSQQLEYKHEIYNSFDVADTRREATFIASYSKNTETKELTLRGTHVRKNIGYVNAQGSRIYCGDYIIYRLPLVYLMLAEIENMQGGDVAKYINLVRERAYSTNWDKAIYGYTNADFTTNELAILHEKDKEFIQEGQRWWDIRRMTLTKGGKHLVFVKEGSIGTDMPTLDEATEAHKVLWPVDKDLLGNDPLIYQTPGYATYKKAE

SEQ ID NO: 10442 - protein, 360 aa, B.fragilis
  UNSURE (308),(347): Identity of amino acid sequences at the above locations are unknown.
KAILMKKTIFLILCILCSLGAMAQKKSITGVITDGAGESIIGASVVEVGTTNGTITDFDGKFSLTIATGAKFTVSYIGYKSQTITVGAENTYNIVLKEDTEVLDEVVITGYGGSQKRATLTTAISKLDNSVLKNAAFSNAGQSLQGSVTGLRVVNKTGQPGSEPDITLRGGATITGDNSKALIVVDGIVRNSMSDINPSDIESIQVLKDAASTAIYGARANGGVILVETKSGKEGKASVNYKFKMGVNFARKGYDFCDAHDYIYYNRLGYKRTGRTNVDTQMGYGIGNNLFDIRYLTDENANLKNEGXASMADPFYDGKTILYKDYSGELDDVVFNNSALTQDHYVXITGGNDKRTFLPA

SEQ ID NO: 10443 - protein, 71 aa, B.fragilis; identical to SEQ ID NO: 6316

SEQ ID NO: 10444 - protein, 752 aa, B.fragilis
IPPGADISPLVYPFPTFLRGRGGILTQIFSLTLGALVGILLFARVAFALNYDRYYQEPENLFLTLRTVVSQGEKKEPVCSNYGKLPAAIRENFPDEVEDATLIDLFSRSSLYHEGQEKKDAILATSRSHIFSTLGVKVLSGNVSELDNMDALFISRSLAQSLFADADPIGKTVMINIDYPLTVRGVFEDIPENAEFRFDGVYSFVTRANRFRDERGGWRGDISYTCMVRFRHPEDVEKVAARMPDMMKKYIQYNKDWFEEFSFITPSQFHLQKKESRKIISILSILGFAILLIAGMNNVLISISSLPQRAKSVGVHKCSGASTGHIYRMFLWESALLILVSLLGVIVLLLYFKPEIEDLSGASLATLFTWRTLWVPALVTIFLFLLIGLLPGKLFSSIPVTQVFHRFTGYRASWKYPLLFVQFTGVAFILGLLMIILLQYNQVMNRSMGYKIDNLVIGWGPFDSMDKIDGILRGLPFIEASCNSASFIYNGHTRQSFTDINGKRFMGCIDFIDEHYVPILGLQILQGRNVHQDGEVLVNEELLRQVGWTDSPIGRKLMEDNYEWGTVVGVVKDYVAQSAYQPQTSVALVSSLERRWEANKRNLILKEPFKENLSKIRALMKETFPTEDIQFRSARQEVDNLYQVVRRFRNIVIVASVSIVVIVLMGLFGFVNDEVQRRSKEIAIRKVNGAESGNIINLLNHNIFWIALPAIFVGIALAYVVGHKWVEQFTDQIVLSSPRDVSDQGGQYHGGQ
